United States Patent 12,545,900 (CGAS/DNCV-LIKE NUCLEOTIDYLTRANSFERASES AND USES THEREOF) - sequence listing, part 2

SEQ ID NO: 3924 - protein, 303 aa, Nitrospira sp.
MAAEEFLSNLARKWEPTELQKQEVAASQRHLRELLHESRLPVLDSYLSGSYSRDTALRPIDDVDIVFIVEPSHWSQWPSLWRPEPYEVLDSFARAIRHRYTLSSVYGQRRSVNLRLSDLDIDVVPALSANEHSSAIYVPDRQARTWILSNPKEHARQATQVNRSRDGQLKPLVKLLKLWNRQLPSTAQVKSFLLETMALRIFRRYGIPSLEEGLVRFWDHMAYAAGEDTVLQWESVGIGLSGWSTSVPDVAETGGDVAGGLDSECRQKFVQRAISSRDKALASLRARNNSYAVDHWKRAFHLL

SEQ ID NO: 3925 - protein, 311 aa, Melittangium boletus
MRIAEFLEELFLDLIQDVEPTPSQKEDAQRTHHTLRYRLDSGNIGLRIIDSYLSGSYVRHTAIAPLDDVDIIFLIDPSKWPRGFLADKPSPSVVLTTFERAIRYRYPDSVVQRQRRSVGLALHKMHIDVVPAILESSESGRIYVLDSETEEWILSAPRVHAEHTTRVNKQREGRFVPLVKVLKFWNKRLPSTACLKSFTIETTAVRLFSEVGFSSFTEGALLFFDFLAQFAGEARQNWRSDFGIKLSRWAWTPTVLDVAGTGSNLVAGLEEQRRVKFLQHAVSSRNRLFEALDARTPERCENRFQAAFRIY

SEQ ID NO: 3926 - protein, 311 aa, Cystobacter fuscus
MRSAEFLEELFLDLIQDVEPTPSQKEDAQRTHHTLRYRLDSGNIGLRIIDSYLSGSYVRHTAIAPLDDVDIIFLIDPSKWPRGFLADKPRPSVVLTTFERAIRYRYPDSVVQRQRRSVGLALNKMHIDAVPAILESSESGRIYVLDSETEEWILSAPRVHAEHTTHVNKQREGRFVPLVKVLKFWNKRIPPTACLKSFAIETIAVRFFSEVGFSSFTEGALLFFDFLAQFVGEARQNWRSDFGIKLSRWAWTPTVPDVAGTGSNLVAGLEEQHRVKFLQHAVSSRNRLCEALDARTPERCENRFQAAFHIY

SEQ ID NO: 3927 - protein, 296 aa, Acidovorax sp.
MACKVEPTATQKKAASASHKYLRELMDTGVIDNRILSSFLSGSYVRGTAVNPLGDVDIIFLIDESKWETGFFATRPKPSVVLRSFADAVRYRYEKSSAFTQRRSIRLELSHIDIDCVPAIEIPGSDYIWVGDRKDDAWIKSSPQLHHTALTKANQLCDGWAVPAIKLLKAWNRSLPATAQVRSFVIETIAVTAFTAAPQKTLQDCVLGFFDFVVQFRSDFLQIGNARLGITISGVFGMTVPDLARTGGNVASGISGDHATSFMDRANRSRELLQGGLHARTEDSAAKHVFSALGWA

SEQ ID NO: 3928 - protein, 308 aa, Unknown
  Description of Unknown: Pelomonas sequence
MASIEGALRSWVKDIEPTPKQKQAASRSYNHLVRVLDRRGVGDRIVDYYLSGSYRRSTALRPIRDIDVIFVIDPSQWDGAYLGLADKPKPSAVLRSFARVLRDEYPNSSTYTQKRSLRLELGHLHIDCVPAVALPNSDLILIGNHADETWFESSPKRHHMELVAANTTNGKLLVPLVKLLKDWNSSLPDEARIRSFVVETLAVTLFSKVRMSSLEEGLYLYFDFVSHFNDQAERRWPSKYDVKMSWWDGIFVPDLAGTGGNVASGIEHSQMKAFKRHAAKSRDELQRAFKAKTDAAAVEYLRAAMNED

SEQ ID NO: 3929 - protein, 353 aa, Acinetobacter lwoffii
MCFLLFYRNNFNRAELIMTTQQQFLDLLSDIEPSTTTVNDCSSAHNTLRDALEEHNEFSKVHVKTFLSGSYIRNTAVRPTAIGGITQRPDVDIIAVTNHTKDDEPQIVLDAIHQALKDIGYTDLTVNRRSVNVKLKKVDMDVVPVIANGDTFLIPDIHLKEWLTTNPPAHTQWTIYVNKQANGNFKPLVKLFKWWKRENLPDLKRPKGFILECLVAKHMDYNETNYEKLFVHLLETIRDSYELYTSLNWIPHLEDPGVAGNNVFSAVTAEEFKTFHEKVKEQATIARNALNETDDDKALTLWRQVLGSRFPRSTSQRSTNSAGIANSLIRPALGLGLTFPSTPVYPNKPGGFA

SEQ ID NO: 3930 - protein, 336 aa, Acinetobacter seifertii
MTTQQQFLDLLSDIEPSTTTVTNCSSAHNTLRDALKEHNEFSQVHVTTYLSGSYKRNTAVRPTTIGGETQRPDIDIIAVTNHTKDDEPKVVLDAVHQALKDIGYSNLTMNRRSVNVQLQKADMDVVPIIVDGDSLLIPDVHLEEWLVTNPPAHTQWTIDVNKKTNGKFKPLVKLFKWWRREHLSELRRPKGFILECLVAEYMDYSESNYEKLFVHLLETISTTYNGYASLNLVPHLEDPGVPESNVFSTVTTDEFKTFHEKIKEQASIARNALNETDNDKALTLWRQVLGSRFPRSASQRSTNSAGIADSLIRPALGLGLTFPSTPIYPNKPGGFA

SEQ ID NO: 3931 - protein, 336 aa, Acinetobacter sp.
MTTQQQFLDLLSDIEPSTTTVTNCSSAHNTLRDALKEHNEFSQVHVTTYLSGSYKRNTAVRPTTIGGETQRPDIDIIAVTNHTKDDEPKVVLDAVHQALKDIGYSNLTMNRRSVNVQLQKADMDVVPIIVDGDSLLIPDVHLEEWLVTNPPAHTQWTIDVNKKTNGKFKPLVKLFKWWRREHLSELRRPKGFILECLVAEYMDYSESNYEKLFVHLLETISTTYNGYASLNLVPHLEDPGVPGSNVFSTVTTDEFKTFHEKIKEQASIARNALNETDNDKALTLWRQVLGSRFPRSASQRSTNSAGIADSLIRPALGLGLTFPSTPIYPNKPGGFA

SEQ ID NO: 3932 - protein, 337 aa, Unknown
  Description of Unknown: Acinetobacter sequence
MTTQQQFLDLLSDIEPSTTTVNDCSSAHNTLRDALKVHNEFSKVHVHTFLSGSYKRNTAVRPTTIGGITQRPDVDIIALTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFFEKVEEQAAIARNALNETDDDKALALWRQVLGNRFPRSASHKSANSADMASSLIRSALGAGLTFPSTPVYPNKPGGFA

SEQ ID NO: 3933 - protein, 337 aa, Unknown
  Description of Unknown: Acinetobacter sequence
MTTQQQFLDLLSDIEPSTTTVNDCSSAHNTLRDALKVHNEFSKVHVHTFLSGSYKRNTAVRPTTIGGITQRPDVDIIALTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFYEKVEEQAVIARNALNETDDDKALALWRQVLGNRFPRSASHKSANSADMASSLIRSALGAGLTFPSTPVYPNKPGGFA

SEQ ID NO: 3934 - protein, 337 aa, Unknown
  Description of Unknown: Acinetobacter sequence
MTTQQQFLDLLSDIEPSTTTVNDCSSAHNTLRDALKVHNEFSKVHVHTFLSGSYKRNTAVRPTTIGGITQRPDVDIIALTNHTINDNPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFYEKVKEQAAIARNALNETDDDKALALWRQVLGNRFPRSASHKSANSADMASSLIRSALGAGLTFPSTPVYPNKPGGFA

SEQ ID NO: 3935 - protein, 337 aa, Acinetobacter sp.
MTTQQQFLDLLSDIEPSTTTVNDCSSAHNTLRDALKVHNEFSKVHVHTFLSGSYKRNTAVRPTTIGGITQRPDVDIIARTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFYEKVKEQAAIARNALNETDDDKALALWRQVLGNRFPRSASHKSANSADMASSLIRSALGAGLTFPSTPVYPNKPGGFA

SEQ ID NO: 3936 - protein, 337 aa, Unknown
  Description of Unknown: Acinetobacter sequence
MTTQQQFLDLLSDIEPSTTTVNDCSSAHNTLRNALKVHNEFSKVHVHTFLSGSYKRNTAVRPTTIGGITQRPDVDIIALTNHTINDNPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFYEKVKEQAAIARNALNETDDDKALALWRQVLGNRFPRSASHKSANSADMASSLIRSALGAGLTFPSTPVYPNKPGGFA

SEQ ID NO: 3937 - protein, 337 aa, Acinetobacter sp.
MTTQQQFLDLLSDIEPSTTTVNDCSSAHNTLRDALKVHNEFSKVHVHTFLSGSYKRNTAVRPTTIGGITQRPDVDIIALTNHTINDDPQIVLDTVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRDSYGIYASLGIIPHLEDPGVAGNNVFSAVTADEFKTFYEKVKEQAAIARNALNETDDDKALALWRQVLGNRFPRSASYKSANSADIASSLIRSALGAGLTFPSTPVYPNKPGGFA

SEQ ID NO: 3938 - protein, 337 aa, Acinetobacter sp.
MTTQQQFLDLLSDIEPSTTTVNDCSSAHNTLRDALKVHNEFSKVHVHTFLSGSYKRNTAVRPTTIGGITQRPDVDIIALTNHTINDNPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVYLLETIRNSYGIYASLGIIPHLEDPGVAGNNVFSAVTADEFKTFYEKVEEQAAIARNALNETDDDKALALWRQVLGNRFPRSASHKSANSADMASSLIRSALGAGLTFPSTPVYPNKPGGFA

SEQ ID NO: 3939 - protein, 337 aa, Unknown
  Description of Unknown: Acinetobacter sequence
MTTQQQFLDLLSDIEPSTTTVNDCSSAHNTLRDALKVHNEFSKVHVHTFLSGSYKRNTAVRPTTIGGITQRPDVDIIARTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVAKHMNYYESNYEKLFVSLLETIRDSYGIYVSLGIIPHLEDPGVAGNNVFSAVTTDEFKTFYEKVEEQAAIARNALNETDDDKALALWRQVLGNRFPRSASHKSANSADMASSLIRSALGAGLTFPSTPVYPNKPGGFA

SEQ ID NO: 3940 - protein, 337 aa, Unknown
  Description of Unknown: Acinetobacter sequence
MTTQQQFLDLLSDIEPSTTTVNDCSSAHNTLRDALKVHNEFSKVHVHTFLSGSYKRSTAVRPTTIGGITQRPDVDIIARTNHTINDDPQIVLDAVHTALKDIGYTDLTVNRRSVNVKLKKVDMDVVPIISDGYGGYLIPDIHLEEWLVTNPPAHTEWTVEVNKNANGRFKPLVKLFKWWRRENLSDLKRPKGFILECLVANHMNYYESNYEKLFVYLLETIRDSYGIYASLGIIPHLEDPGVAGNNVFSAVTADEFKTFYEKVKEQAAIARNALNETDDDKALALWRQVLGNRFPRSASHKSANSADMASSLIRSALGAGLTFPSTPVYPNKPGGFA

SEQ ID NO: 3941 - protein, 337 aa, Acinetobacter pittii
MTTQQQFLDLLADIEPSTTTVNDCSSAHNTLRDALKVHNEFSKVHVHTFLSGSYKRNTAIRPTIIDGNTQRPDVDIIARTNHTINDDPQIVLDAVHTALKDIGYNDLTVNRRSVNVKLKKVDMDVVPIISDGYGGYLIPDIHLEEWLSTNPPAHTEWTIEMNKNANGRFKPLVKLFKWWRRENLSELKRPKGFILECLVAKHMDYDESNYEKLFVFLLEKIRDFYEIYASIGIIPHLEDPGVAGNNVFSAVTADEFKTFYDKVKEQASIARNALNETDSDKALALWRQVLGNRFPRSASHKSANSADMASSLVRSALGAGLTFPSTPVYPNKPGGFA

SEQ ID NO: 3942 - protein, 337 aa, Moraxella osloensis
MTTQQQFLDLLSDIEPSTTTVNDCSSAHNTLRSALEVHNTFSKVHVKTFLSGSYKRKTAIRPTTIAGVTQRPDVDIIALTNHTKDDKPQVVLDAVNEALKDVGYTALTINRRSINVKLMKVDMDVVPIISDGYGSYLIPDIHLDEWLATNPPGHTEWCVELNKQANGRFKPLVKLFKWWRRENLPDLKRPKGFILECLVAKHMNYNESNYEKLFVYLLEEIKDFYGIYASLGVMPYLEDPGVPGNNVFSAVTIEEFKDFYEKVKEQAILARSALNEVDDDAALALWRQIMGNRFPKAASHKISNSDNTSRSLIRPALGIGLTFPSNPVYPNKPGGFA

SEQ ID NO: 3943 - protein, 335 aa, Massilia sp.
MTTQQQFLDLLKDIEPSPSTVATCSSAHNTLRDSLAEHEEFGDVHVRTFLSGSYIRDTAIRPTLVDGVLQRPDVDIIAVTDHTTEDEPKVVLDAVHKALVDAGYKTLTVNRRSINVKLVKVDMDVVPVIANGDSYLIPDIHLEEWLPTNPPAHTQWTIDVNSDANGRFKPLVKLFKWWRRVHLADIKRPKGFILECLVAEHMSYSETSYETIFASLLEAIRDSYRGYVTLGMVPFLEDPGVPGNNVFSAVTADEFKTFYNKVEEHASLAREAHNEADDEKALKLWRKVLGPRFPASAAAQRSTSGLANSLLRPAVGVGLTFPAAQVLPNKLDGFA

SEQ ID NO: 3944 - protein, 334 aa, Pseudorhodoferax sp.
MTTQQQFLDMLSEIEPSASTVAACSSAHNRLRDGLAEHDEFREVHIRSFLSGSYKRDTAIRPTSVGGILQRADVDIIAVTGHTAQDEPQVVLDAVHQALKDAGYVNLTVNRRSINVRMVTVDMDVVPVIEDGDAYLIPDMHLEEWLATNPSAHTQWTIDVNAAAGGRFKKMVKLFKWWRRLHMPADLKRPKGFILECLVAKHMSFSETNLETLFVTLLEAIRDAYAFTVLLERVPFLEDPGVPGNDVFSAVKAEEFKTFYDKVSEHATLARKAKNETDENEALKLWRRVLGSCFPASAGQRSTSSLSSLLRPAVGAGLTFPATAVYPNKPGGFA

SEQ ID NO: 3945 - protein, 335 aa, Variovorax sp.
MTTQQQFLDMLSEIEPSPSTVAACSSAHNTLRDALAEHDDFSEVHVGTFLSGSYKRDTAIRPTRVDGVLQRADVDIIAVTNHTAEDDPKVVLDAVHQTLVDAGYKNLTINRRSINVKLVTVDMDVVPVIENGDAYLIPDIHLEEWLVTNPDAHTDWTIETNAKAGGRFKKLVKLFKWWRRLHMPADLKRPKGFILECLVAKHMSYTETNLETLFVTLLEAIRDAYYLTALLGQVPSLEDPGVPGNNVFSAVKAEEFKTFYDKLSEHAALARKAKDETDGKEALKLWRDVLGACFPASASQRSDSAKATSLLRPAVGAGLTFPATAVYPNKPGGFA

SEQ ID NO: 3946 - protein, 332 aa, Burkholderia sp.
MTTQQQFLDFLWEIEPSASTVNACSSAHNTLRAALRTDKNLSKLHVETFLSGSYKRDTAIRPQKIGGVLQRPDVDVIVVTSHSEEDDPHDVLDALHQALVDAGYKNLKVNRRSIAVPLAGVDMDVVPVIEDGDAYLIPDLELKRWLTTNPRAHTQWTVDVNRGVGGRFKPLVKIVKWWRRCHLSALRRPKGFILECLVAKHMSYSQVNYETLFVEVLEGIRDAYSLHVLLGQVPFVEDPGVPGSNVFSNVTIEEFKIFYDMVKEHAVLARKAKNETNDDEALRLWRAILGPRFPAAAGVSKSAASSLLRPAVGAGLTFPATPVLPNKHAGFA

SEQ ID NO: 3947 - protein, 332 aa, Paraburkholderia phenazinium
MTTQQQFLDFLWEIEPSASTVNTCSSAHNTLREALRTDKNLSKLHVETFLSGSYKRDTAIRPQKIGGILQRPDVDIIVVTSHSGEDDPHDVLDALHQALVDAGYKNLKVNRRSIAVPLAGVDMDVVPVIEDGDAYLIPDVELKRWLTTNPSAHTQWTVDVNRGAGGRFKPLVKIVKWWRRCHLSALRRPKGFILECLVAKHMSCSQVNYETLFVEALESIRDAYSLHVLLGQVPFVEDPGVPGSNVFSNVTIEEFKIFYDMVKEHAVLARKAKNETNDDEALRLWRAILGPRFPAAAGVSKSAASSLLRPAVGAGLTFPATPVLPNKHAGFA

SEQ ID NO: 3948 - protein, 331 aa, Variovorax paradoxus
MTTQQQFLDLLWEIEPSTSTVDACSSAHRTLRSALRSDENFGKLHVATFLSGSYKRDTAIRPQKIEGILQRPDVDIIVVTSHTEGDDPHDVLDALHQALVDCGYANLKVNRRSIAVTLGSVDMDVVPVIVNGNSYLIPDRELKKWLPTNPRQHTQWTVDVNSDADGRFKPLVKLVKWWRRIHLSSLRRPKGFILECLVAEHMDYNQKNYETLFVELLETIRDTYRYYALLGQVPHLEDPGVPGSNVFSNVTAEEFKTFYDKLEEHADLARKAKDETDDTEALRLWRSVMGSRFPAAAPARALGSSLIRPAIGVGLTFPSMPVFPNKPGGFA

SEQ ID NO: 3949 - protein, 336 aa, Candidatus Accumulibacter sp.
MATQQQFIEFLSEIEPSPSTTQVCSAAHRTLRGKLAAHPTYKAIHRETYLSGSYARDTALRPRVSDGTLRRPDVDIIVVANHTQYDQPSDVISMLRRAVKQSGYEEIESNRRSICVTLGSVDMDVVPVIANPWQPGGWLIADKSDERWLETNPMGHNDWARAVNKRANGNFKPLVKLVKWWRRENLPHLKRPKGFIIETMVAELMDYRENSYEELFAKLLDRISTEYQWLAATGQVPHLADPSVEGNNVFSRVKPEDFKRFYDLAADHAQRVRRAQREPDPDKALVQWQRVFGDRFRKPTPKSGGLLRTAAAASGGMGLAFPAKAVVPPNKPPGFA

SEQ ID NO: 3950 - protein, 342 aa, Pelomonas sp.
MPTQQQFIDFLREIEPSPSTTAVCSSAHNTLRANLAGHATYSLIHDNTFLSGSYARDTALRPRMTNGVLRRPDVDIIVVTKHKRTDTPSDVIKSLHRAVKSLGYASVESNRRSICVTLTSVEMDVVPIIPNPWQTGGWLIADKSTQEWIPTNPMGHTDWAIKINKKANGNFKPLVKLVKWWRRENLPNLRRPKGFILETIVAELMDYKETRYEELFVKLLERIVSEYAWNALLGTVPSLADPSVEGNNVFSRVQADEFKRFYDMAEKHAKLIRRAQKEPDADKALGMWQQVFGDRFRKSAPRSGSLLRDAAPASAATAAAGGLGIGFPARAVTPPNKPPGFA

SEQ ID NO: 3951 - protein, 335 aa, Achromobacter denitrificans
MATQQQFIDFLSEIEPSSTTKSVCSSAHSTLRGKLEQHETYKDIHVNTYLSGSYARNTALRPRQSNGTVRRPDVDIIVVTNHMESDLPSNVIGTLRRAVRSLGYAEVEANRRSICVSLGSVEMDVVPVIHDPWEANGWLIADKSEERWLKTNPMGHNLWASGVNKKANGYFVPLVKLVKWWRRENLPHLRRPKGFILETLVAKHMDYKETGYEELFAKFLESVRDEYGWMVLSGVVPSLEDPSVPGNNVFSRVKAEEFKRFYDMAEAHATLVRRAQRETDSDKALALWQKVLGDRFRKPAQKTSMLRQAAAASAGLGLGFPSIAVVPPNKPAGFA

SEQ ID NO: 3952 - protein, 335 aa, Pseudomonas putida
MATQQQFIDFLKEIEPSPTTKSICISAHSTLREKLEKHETYRDFYVSTYLSGSYARNTALRPRVANGTLRRPDVDIILVTNHTLQDLPSDVITTLRKAVKSLGYAEVDANRRSICVSLESIEMDVVPVIANPWQEGGWLIADKSEERWLVTNPMGHNQWASSVNKKANGYFVPLVKLVKWWRRENLPHLRRPKGFILETLVAEHMDYSETSYEELFAKFLEAVRDEYEWMVQAEQVPYLQDPSVPGNNVFSRVKPEEFKRFYDMIDAHAKLVRRAQSETDADKALTIWQKVFGDRFRQPVQKASMLRTATVAGSGMGLTFPAIAVVPPNKPQGFA

SEQ ID NO: 3953 - protein, 334 aa, Rivularia sp.
MITQAQFLKFLQDIEPSYTTKNNASSSHSRLREFLNKHPEFGQYILTTFLSGSYKRDTAIRPQTKKGNTERPDIDIIVVTIHTINDSPAAVVELLYIILKTEYENIRRQARSIGIQAPLADMDVVPIIAPYGLENTLYIPDRKLEKWLVTNPPGHTVWTTQVNKASNGNFKPLVKLMKWWRRNNRTISKHPKGFVIESIVAECMNYQENQYADLFLGTLEAIVSRYAIDIACGRVPLIQDPAVPGNYVTTQITFDAFKGFYNKVKDHAELGRLAQAEKDPVKSLTMWREIFDIRFPSSETANFSGLLETPARPEGGMTFPDRPIVPTNKPRGFA

SEQ ID NO: 3954 - protein, 346 aa, Bacillus patagoniensis
MIIVQTYGKNGEVIYLGAHSQFRKLLSDIEPSQHTKSDASTGHENLRKFLKGDEIFKNYRETDFLSGSYKRNTAIRPRIKDGVVSRPDVDIIVVTNHTENDDQKEVIDLLYDTLKPKYSTIRKQARSVGIETNKVDMDVVPIIAPDGMDGNLYIPDRKKEQWVETNPPKHTEWTTEVNTDSGGRFKPLVKLMKWWRRQNPTIAKKPKGFVIECIAAECMDNNEKKYDELLVGTLEKIVEKYAFYIGLRLVPHIEDPGVPGNSVTNGITFDAFEGFYYKAKSHAEKGRQAINETDKEKALKLWREIFGPRFPSPEVANSSSLLKNAAEPSLSFPGRPVKPNKPGGFA

SEQ ID NO: 3955 - protein, 340 aa, Bacillus sp.
MEKNRGVIYLGAHSQFRKLLSDIEPSQNTKSDASTGHENLRKFLKGDEIFKNYRETDFLSGSYKRNTAIRPRIKDGVVSRPDVDIIVVTNHTKNDDQKEVIDLLYDTLKPKYSTIRKQARSVGIETNKVDMDVVPIIAPNGMDGTLYIPDRKKEQWVETNPPKHTEWTTKVNTDSGGRFKPLVKLMKWWRRQNPTIAKKPKGFVIECIAAECMDNNEKKYDELFVGTLEKIVEKYAFYIGLRLVPHIEDPGVPGNSVTNGITFDAFEGFYYKAKSHAEKGRQAINETDKEKALKLWREIFGPRFPSAEVANSSSLLKNAAEPSLSFPDRPVKPNKPGGFA

SEQ ID NO: 3956 - protein, 331 aa, Unknown
  Description of Unknown: Sporosarcina sequence
MSTQSQFKKLLSDIEPSQTTKNDASLGHKNLRKHLQDDDTFKVYRQTDFLSGSYKRNTAIRPRKKDGVVSRPDVDIIVVTNHTKYDGQQEVIDLLYDTLKPKYPTIRKQARSVGIETNNVDMDVVPIIAPNGMDGTLYIPDRKKEEWVETNPPKHTEWTTEVNTDSGGQFKPLVKLMKWWRRQNPTIAKKPKGFVIECIAAECMDKDEKQYDELFVGCLEKIVEKYAFYIGLRMVPHIEDPGVSGNSVMNGITFEAFEGFYYKAKSHAEKGRNAIDETDKEKELKLWREIFGSRFPTIESANSSSLLKNAVEPSLSFPDRPVKPNKPGGFA

SEQ ID NO: 3957 - protein, 331 aa, Bacillus oceanisediminis
MVTQNQFLELLKDIEPSKTTKEDASKAHTAIRNFLQKDDDFKPYHVSDFLSGSYKRNTAIRPRTVDGKTARPDVDIIMVTNHTLDDKPQDVIDLTYDVLKDEYQIIRKQARSVGINTNKVDMDVVPIIAPDGMEGTLYIPDRKIEKWIVTNPPKHTSWTTEMNNTSAGMFKPLVKLMKWWRRVNPTIAKKPKGFVIECIVAECMDKSETQYGELFVKTLEQIVKKYKLYIDLKIVPKIDDPGVPGNSVTDGITFDAFNGFYNKAKSHAEIGRKALNEASEEEALKLWRSIFGARFPESKKNTNSLLKSALIPPALTFPDRPVEPKKPGGFA

SEQ ID NO: 3958 - protein, 331 aa, Bacillus sp.
MATQKQFLAFLGDIEPSTTTKGDASKAHTDLRSFLEKDATFKPYRDSDFLSGSYKRDTAIRPRIVDGKITRPDVDIIVVTNYTQADDPKDVINLLYDVLKKQYPNIRKQNRSVGINTGKADMDVVPIIAPDGMDGKLYIPDRKQEKWLETNPPKHTIWTIGVNQESKGMFKPLVKIMKWWRRVNPTIAKKPKGFVIECIVAECMDKSETKYAELFVKTMEEIVNKYEIYVRLGIVPTIGDPGVPGNSVTDGITFDAFKGFYDKVKLHAEMARKALEETNEDEAVKLWRSIFGPRFPKSKKSSSPFVKSALIPPPLTFPDRPIEPKKPGGFA

SEQ ID NO: 3959 - protein, 331 aa, Bacillus toyonensis
MVTQNQFLEFLKDIEPSKTTKDDASKAHNDLRSFLEKDADFKPYRESDFLSGSYKRDTAIRPRIVDEKTTRPDVDIIVVTKYTKEDDPKEVINLLYEVLKKQYPNIRKQARSVGINTEKADMDVVPIIAPDGMEGKLYIPDRKQEKWLETNPPRHTIWTTEMNQESAGMFKPLVKIMKWWRRINPTIAKKPKGFVIECIVAECMDKSETKYGELFVKTMEEIVKKYETYVQLEIVPTIDDPGVPGNSVTDGITFDAFKGFYNKVKSHAEIGRKALEETNEDEAVKLWRSIFGHRFPKGKKSSSSFVKSALIPPLLTFPDRPVEPKKPGGFA

SEQ ID NO: 3960 - protein, 331 aa, Bacillus pseudomycoides
MVTQNQFLEFLKDIEPSKTTKDDASKAHTDLRSFLEKDADFKPYRESDFLSGSYKRDTAIRPRIVDGKMTRPDVDIIVVTKYTKEDDPNEVINLLYDVLEKQYPNIRKQARSVGINTGKADMDVVPIIAPDGMEGKLYIPDRKQEKWLETNPPRHTTWTIEMNQESKGMFKPLVKIMKWWRRVNPTIAKKPKGFVIECIVAECMDKSETKYGELFVKTMEEIVKRYEIYIQLGTVPTIDDPGVPGNSVTDGITFDAFEGFYNKVKLHAEIGRRALEETNEDEALKWWRSIFGQRFPKSKKSSSSFVKSALIPPSLTFPDRPVEPKKPGGFA

SEQ ID NO: 3961 - protein, 331 aa, Paenibacillus sp.
MITQAQFISFLRNIEPSPTTKSNASDGHIKLRNYLHGHFAYKQKYVNSFLTGSYKRDTAIRPKIVEGETARPDVDIIVVTNHTRSHNPQEVITILYDALKPAYPTIRPQNRSVGIKTDKVDIDVVPIIAPYGMEGTLYIPDRKKVQWIETNPPNHTSWTTEVNQGSGERFKPLVKLMKWWRRENGTNAKKPKGFVIECIVAECMDRNQTQYGELFVGTLERIVDKYAISIALKVVPVIQDPGVSFNSVTNGMTFEAFERFYNKVKLHAIIGREAINELDAEKSLQKWRVLFGGQFPKSGMTQTNSLIASAISPSLSFPNHAVEPKKPEGFA

SEQ ID NO: 3962 - protein, 331 aa, Paenibacillus sp.
MITQTQFTSFLTDIEPSQTTKTDASNGHTKVRDFLSGHATYKKYYVSSFLSGSYIRDTAIRPKIKEGTVARPDVDIIIVTKHTLSDDPQSVIDSLYSTLRSEYSIIRKQNRSVGIQTDKVDIDVVPIIAPNGIEGTLYIPDRKKEQWIITNPPKHTVWTTEINQDCSARFKPLVKLMKWWRRENTTLAKKPKGFVIECIVAECMDRQQTNYGELFVGTLEKIVEKYKIYISLGSIPHISDPGVSGNSVTAGMTFDAFEGFYNKVKAHAKIGREAIDEKDADKSINKWRILFGDRFPKSSVVQNNSLLASAVAPTLAFPNRAVEPKKPGGFA

SEQ ID NO: 3963 - protein, 336 aa, Dehalococcoides mccartyi
MSEIPQARFLELLQDIEPSATTNKNASEAHTELRDFLKADPEFSKYHSSDFLSGSYKRDTAIRPRKKGDQVDRPDVDIIVITNHTTDADPKEVVNLLFRTLKKKYPNIRRQNRSVGIEYYKADMDVVPAIPNGSRLLIPDRDSNTWVTTDPEKHTSWTADINQRTEGRFKPLVKLIKWYRRQHPTNSKKPKGLTLECMVAECMDYQETDYGELFVKTLENMVRRYDAIVSIGFVPTIQDPAIPGNSVTDDIKYEDFREFFHKIKDHAKVGRDALNCTDCDEATGLFREVLGDRFPKTTSNRAKSTLAEPVVATSATFPNRPIRPNKPTGFANVVSG

SEQ ID NO: 3964 - protein, 370 aa, Methylophaga frappieri
MGLNEKPVGTTIRCNFTTIKCRDQNQPLGRLHEMTPNARFSEFIKDITPSNTTVSNCQSAHKDVRTALLNDDELKNKIKRIILGGSYKRSTAIRPRVKNGSTERPDVDLYVVVDGSPLFSDPSDLMDEIYAALNRARKDLGITSLKRNRCSIALSMNKADLDVSPLLERQHDALYRIGNRITGEWYKTDPEEHTNWSAQQNKRCSGRFNSLTRMVKWARRHNKTVSRHPKSFALEAFIAPNISEIETHYGQLFHDWCQNFLDLYEDDRLFSICPVLEDPAVPGGDILSGVTDEEFCAYYDKVKTHRDNSAKALKEDDEEKACEYWRKIFGERFPKPKQSTNSTKSSAITMSPLSFTGTEAAPTERPAKFA

SEQ ID NO: 3965 - protein, 337 aa, Pseudooceanicola flagellatus
MTPNARFTEFIKDITPSDTTVANCQRAHTSVRMALLNDDTFKGRVKRVFLGGSYKRFTAIRPTKKGETTERPDVDLYVVIEGHPWFADPAELMDELFAALNRARDELGVTKIKRNRCSIALSMNKADLDVSVLLDRQEDDLFRIGNRNTGEWYETDPEEHTDWSAAQNARCSGRFNPMTRMVKWARRQNKTVSRHPKSFGLEALIAPHISEMETHYGQLFHDWCDAFVNAYSFERMLGICPSLQDPAVPGGNILEGVTGDEFCAYYDKIKKHRDDSAKALEEGDQDKATDYWRRIFGDRFPKAKQSGQSTKSAAAAMSPLSFTSAKAAPSARPAKFA

SEQ ID NO: 3966 - protein, 337 aa, Parvularcula oceani
MTPNARFQEFIKDITPSPTTMANSKSAHESVRMALKADKEFKDKFKRVFIGGSYKRSTAIRPRTKQGSTERPDVDLYVVVDGHPWFADPEEWIDDLYDALNRARKDLGITKIKRNRCSIALSMNKADVDVSILLERRSDGLYRIGNRTTGEWYKTDPEEHTEWSAAENKRFSGRFNAMVRMVKWARRENKTVSRHPKSFQLEMFVAPDMDMSETHYGQLFHDWCDAFVDRFKSNRDSENCPRIEDPAVPGADILAGVSDEAFCVYYDKIKKHRDDARKALDADNQDKAITYWRRIFGDRFPKPKTASGGTKRSATRMSPLSFKSAQAAPISRPAKFA

SEQ ID NO: 3967 - protein, 296 aa, Leucothrix mucor
MIRTFLGGSYKRKTAIRPVSKNGKTDRPDVDIYVVVKGSDWSESPEDLINTLFSALNRNCTELKITKIKRNRCSIAISTDKAEMDVSPLLERNSDGYYRIGNRNTGEWYLTDPEEHTTWSAKANSDAGMRFNPMVKMVKWSRREYPTKNKHPKSIALEALVAKHMSSTETHYGQLLHDTFDDIINSYSFLRLIGMCPELDDPAIDGGNLLSGVSGEAFSAFYDKIKYFRDEAAKALATDDQDVATKHWRQILGSRFPSPKTEKSSNAVGLQSAVTMSSLTFPAKASTPPNKPADFA

SEQ ID NO: 3968 - protein, 345 aa, Marinicella sp.
MTPNARFLEFIKDITPSATTNSRSVSAHTSVRDAITSDDDFKNEVKRTFLGGSYKRKTAIRPVKKGDDTERPDIDIYVVVNGSTSPASSDYKTPDDLIEELYSALNRNRKTLGITKITRNRCSIAISTNKADMDVSPILERNDEGYYRIGNRNTGEWYLTDPEEHTNWSAKVNADANMRFNPMVKMVKWNRREFPTKNKHPKSIALEALIAKHIDRNESHYGQILHDTFNEIVDHYSTYRDLDLCPTLDDPAIENGDLLNGVTGEVFSAFYDKIEYFRDEASKALAAEDQDIATKHWRRILGDRFPSTKASKSDSSIGMQEAATMSPLTFPSAPSTPPNKPADFA

SEQ ID NO: 3969 - protein, 337 aa, Unknown
  Description of Unknown: uncultured bacterium sequence
MPVPQARFTELLEDIEPSQTTKTKASGGHNGIRKHLRTQQSFKDRYVSSFLSGSYARSTSIRPRTSAGELERPDVDIIVVTNFSTSDHPDDVLKEVCRALEDGGNGYVVERINKRSVRVETWQAEMDIVPVVPAWNGYMIPDRDTGTWKFTNPPVHTSWSAEQNQRFGGRFKPLVKLFKWWRRMNPSGRRPKGFVLEVLVSRHAPATETHYGEGFAQLLANIYNEYAWLAANNQKPFLADPADPSNDILGKVSVAQWKDFIEKVRVYADIARRAQDAVDMDEATRQWRRVFGDRFKLTANVAKAATYGGFAAAAPVAAGYTFPNAMAAPANKPRGFA

SEQ ID NO: 3970 - protein, 337 aa, Paracoccus sanguinis
MAVPQARFTELLDDIEPSQTTKTRASGGHTGIRDHLRTQAQFKDRYVSSFLSGSYARSTSIRPRSTAEGVERPDVDIIVVTNFTTNDHPDNVLREISRSLLDGGNGYPVERINKRSVRVETWQADMDIVPVLSTWNGYMIPDRDTGTWKFTNPPVHTDWSTNQNQRFGGRFKPLVKLFKWWRRINPSGRRPKGFVLEVLAARHAPTAETHYGEAFAQLLADIYSAYAWMAVNNQKPVIADPADPSNDILGKVTVAQWKDFIEKVRVYADVARRAQDATDLDEATRLWRRVFGDRFKYTANPARAANYGGFAAAAPVGAGYTFPNSMAAPVNKPRGFA

SEQ ID NO: 3971 - protein, 337 aa, Mesorhizobium amorphae
MPVPQARFTELLADIEPSPTTKSHASGGHSGIRDHLRTQEEFKDRYISSFLSGSYARDTSIRPRTSADGQERPDVDIIIVTNFETSDHPDDVLNEVCRALEDGGDGYEVERINKRSVRVETWQADMDIVPVVQTSNGYMIPDRDNGTWKFTNPPVHTSWSAEQNKRFGGRFKPLVKLFKWWRRINPSGKRPKGFVLEVLVSLHAPTAETHYGAAFAQLLTNIDKAYGFLASLDQKPFIADPADQSNDILGKVKLAQWKDFIDKVRVYADIARRAQETDDMDEATRQWRRVFGDRFKATANPAKAASYGGFAAATPLAAGYTFPDAMAAPASKPRGFA

SEQ ID NO: 3972 - protein, 337 aa, Paracoccus yeei
MPVPQARFTELLADIEPSPTTKSQASGGHTGIRDHLRKQEKFKDRYVSSFLSGSYARSTSIRPRTSADGEERPDVDIIIVTNFETSDHPDDVLKEVCRALEDGDDGYPVERINKRSVRVETWQADMDIVPVVQTWNGFMIPDRDNGTWKFTNPPVHTSWSAKQNERFDGRFKPLVKLLKWWRRINPSGRRPKGFVLEVLASVHAPTAETHYGEAFAQLLKNIYDAYGFLASLDQKPFIADPADQSNDILGKVTVAQWKDFIEKVRVYADIARRAQDAGDMEEATRQWRRVFGERFKVTANVAKAASYGGFAAAAPVAAGYTFPNAMAAPANKPRGFA

SEQ ID NO: 3973 - protein, 338 aa, Novosphingobium sp.
MPVPNTRFIELLQDIEPSTTTKTRASGGHTGIRDHLRTQAKFKDRYVTSFLSGSYARDSAIRPRSTSNGQERPDVDIIIVTNFSTDDHPDTVLKEVCKALEDGGDGYEVERINKRSVRVETWQAEMDIVPVASTWNGYMIPDRDTGTWKFTNPPVHTSWSSAQNTRFGGRFKPLVKLFKWWRRINPLTGRRPKGFVLEVLVGLHAPTGETHYGEAFAQLLENIYDAYGYHTSIGQKPFIADPADGSNDILGKVSVAQWTEFIEKVRVYAGIARRAQDADDIEEATRQWRRVFGDRFKATATPAKASTYGGFAAAVPVAAGYTFPNAMAAPPTKPRGFA

SEQ ID NO: 3974 - protein, 338 aa, Sphingobium chungbukense
MPVPNTRFSELLQDIEPSTTTKTRASGGHTGIRDHLRTQAKFKDRYVTSFLSGSYARDSAIRPRSTSNGQERPDVDIIIVTNFSTDDHPDTVLKEVCKALEDGGDGYEVERINKRSVRVETWQAEMDIVPVASTWNGYMIPDRDTGTWKFTNPPVHTSWSSAQNTRFGGRFKPLVKLFKWWRRINPLTGRRPKGFVLEVLVGLHAPTGETHYGEAFAQLLENIYDAYGYHASIGQKPFIADPADGSNDILGKVSVAQWTEFIEKVRVYAGIARRAQDADDIEEATRQWRRVFGDRFKATATPAKASTYGGFAAAAPVAAGYTFPDAMAAPPAKPRGFA

SEQ ID NO: 3975 - protein, 338 aa, Sphingobium amiense
MPVPNTRFSELLQDIEPSTTTKTRASGGHTGIRDHLRTQAKFKDRYVTSFLSGSYARDSAIRPRSTSNGQERPDVDIIIVTNFSTDDHPDTVLKEVCKALEDGGDGYEVERINKRSVRVETWQAEMDIVPVASTWNGYMIPDRDTGTWKFTNPPVHTSWSSAQNTRFGGRFKPLVKLFKWWRRINPLTGRRPKGFVLEVLVGLHAPTGETHYGEAFAQLLENIYDAYGYHASIGQKPFIADPADGSNDILGKVSVAQWTEFIEKVRVYAGIARRAQDADDIEEATRQWRRVFGDRFKATATPAKASTYGGFAAAAPVAAGYTFPNAMAAPPAKPRGFA

SEQ ID NO: 3976 - protein, 339 aa, Pseudooceanicola batsensis
MTVPNARFTELLQDIEPSSTTKSHASTAHIKMREHLRTQSDFKDLYTGSFLSGSSARDTALRPRTSAGQVERPDIDIIVVTDFSTDDDPEWVLKKVCRAIEDKGIGYPVERMNRRSVRVNTWRAEMDIVPVVEDGTEGYWIADRESGTWQFTNPPVHKTWSAEQNAIFNGRFTPMVKLFKWWRRINPTSGKRPKGFVLERLVSLHAPVGEAHYGEAFTQLLENIQSAYEINAALGMKPFISDPAVPGNDILSRVTVAQWQEFIRKVATYAAIARKAQDADDLDEATRQWRRVLGDRFKTTQKTKASASAFGTFATATPAPGYSFPDAMAAPTTKPRGFA

SEQ ID NO: 3977 - protein, 331 aa, Unknown
  Description of Unknown: alpha proteobacterium sequence
MVPNARFTELLADIEPSPTTKSNASSAHTNLRAHLRGHKDFADLWRDDFLAGSYSRDTAIRPRKTEDGHERSDVDIIVVGDFKTSDDPETVLFDLADVIGDEYEVERINKRSVRAIDGDAEMDVVPVIAQWDGSYLIADRETGLWIPTNPPKHNEWSSARNKDYSGRFKPLVKMQKWWKRENPTGKRPKGFVLEVLTTHAPTGETHYGEAFAQMLENVYNTYKVGASLGIKPPIADPAIPGNDILAKVTVAQWQAFIEKARVHAGYARRAQDEDDMEEATRLWRKVFGARFKATANVAKAAAASVFATAPAASGYQFPNTPAAPNKPRGFA

SEQ ID NO: 3978 - protein, 331 aa, Unknown; identical to SEQ ID NO: 3977
  Description of Unknown: alpha proteobacterium sequence

SEQ ID NO: 3979 - protein, 333 aa, Burkholderiales bacterium
MVPNTRFTELLADIEPSPTTKGEASSAHTGVRAHLRDHPEFKNRWSSDFLAGSYKRDTAIRPKKTAEGHERPDVDIIVVTTFSTADHPDDVLDELSDALGEAYDVERINKRSVRIVTARAEIDVVPVVEHGDLYQLPDRDLGHWKLTNPPAHTDWSADQNKVFGGRFKPLVKLLKTWRRENKAGKRPKGFVLEVLVSKHAPKSETHYGEAVAQLLENIYAEYGATAALGIVPVIDDPGLPGNDIMSKVSVTDWKAFIERVRVHAGYARRAQTEQDMEEATRLWRTLFGDRFKATANAAKSDSLARYAAAPAAGSGYTFPSTPAAPANKPRDFA

SEQ ID NO: 3980 - protein, 333 aa, Deinococcus sp.
MLPNARFKELLADIEPSATTTAQASLAHQSVRDHLCSHSEFKERWEGSFLAGSYTRDTAIRPKRTADGHERPDVDIIIETNFSTTDDPTDVLWEVNDALEDQFTVERVNKRSVRVITANAEIDVVPVVASGTGYMLPDRDLGYWKSTNPPAHTTWSANQNARFGGRFKPLVKLLKWWRRENKTGKRPKGFVLEVLVSLHAPTDETHYGEAFAQLLENIHAAYADLAALDLKPTLADPAMPGNDILSKVSITDWKNFLDRVRVHAGYARKAQSLNADEMDEATRLWRILFGNRLKATESAVKASHLGSTATATASAGYTFPDVNATPTKPRGFA

SEQ ID NO: 3981 - protein, 337 aa, Rhizobium etli
MVPNARFLELLQDIEPSTTTKTNSSKAHTGVRDHLKVQDDFKTKIVRDFLSGSYARNTSIRPKTDADGVVRPDVDIIIVTNYTTDDEPEDVLNDLCAALEDGGDGYEVERINKRSVKLITPLAEMDVVPVIEWGEQYKIPDRETGEWKLTDPPGHINWSRDRNNDFGGRLKPLVKLFKWWRRENNSGKRPKGFVLEVLTALHAPQDETHYGEAFAKMLENIRQAYAFQAEMDIKPVILDPSVAGSDILAKVSITQWKAFMDKVKTYADYARKAQSTDNMDDATWYWRKVFGSRFPATETEKVAKASNLLEKAAATAGTSSYVFPDAMAAPTKPRGFA

SEQ ID NO: 3982 - protein, 337 aa, Ensifer sojae
MVPNARFLEFLQDIEPSPTTVSNSSKAHTGVRNHLKAHDDFKAKIEGDFLSGSYARNTSIRPKTDADGVVRPDVDIIIVTNYTEDDEPDDVLNDLCAALEDGGDGYVVERINKRSIKLITSLAEMDVVPVIEWGEQYKIPDRESGEWKLTDPPGHITWSRDRNSDFGGRLKPLVKLFKWWRRQNNSGKRPKGFVLEVLTALHAPQNETHYGEAFAQMLENIHKAYAFQAEMDIKPIIYDPSVAGSDILAKVSITQWKAFIAKVKTYADYARKAQSTDNMDDATWYWRKVFGSRFPATETEKVAKASSLLEKAAATAGTSSYVFPDAMAAPTKPRGFA

SEQ ID NO: 3983 - protein, 335 aa, Shinella sp.
MVPNARFLELLQDIEPSPTTVKNSSKAHIGVRDHLKAQDDFKAKIVRDFLSGSYARDTSIRPKTDADGVVRPDVDIIIVTNYTTADAPEDVLNDLCDALEGGDDGYEVERINKRSIKLITPLAEMDVVPVIEWGSQYKIPDRESGEWKLTDPPGHVQWSIDRNKEFNGRLKPLVKLFKWWRRENNSGKRPKGFVLEVLTALHAPKTEAHYGEAFAQMLESIHKEYGFQAEMDIKPVIYDPSVAGSDILAKVSITQWKAFMAKVKTYADYARKAQSTDNMDDATWYWRKVFGSRFPATETVAKASSLLEKAAATAGTSSYVFPDAMAAPTKPRGFA

SEQ ID NO: 3984 - protein, 295 aa, Mesorhizobium ciceri
MLPNSRFEELLRDIEPKQGIRDSASEAHYSIRNYLRDHPVFSERLNQDFLAGSYSRHTAIRPSTAGGDEFRPDVDVYVELRYGFGADPRDILKNLRRVLQENYNVERMNRRSVRIRMPLVDVDVVPLIRSGKGFKIPDRRDEEWMQTDPLFHNAWSAAMNVEFQSRFKPLVKLIKWWRRVNFGSRRPKGFSLEILTAAHAPSDEYHYGEAFAQFLENIEEAYGDRPYEKPTLGDPAVRGKDILSNVSQKDWDDFMDLVADHATMARLAQKTGNDKLAMDLWRQVLGPRMGWGFSA

SEQ ID NO: 3985 - protein, 378 aa, Comamonadaceae bacterium
MILEADFASFLQDIRPTKAMRDDLKTGHQTLRDRLNADEGLKKCLVSDFLQGSYKRSTAIRPKGDRRSDVDIIVVTKLSEQEYTPAKAMDIFTPFLDKHYKGKWRQQGRSFGIELSYVELDLVLTSAPSEAEMGILRSEALSADDSLEDDPEWRLHRSWLGLSSRYRSDARTLIAEAKNEPEWKSQPLRIPDRDANKWESTHPLAQITWTRDKNNRTGKHFVNVVKAIKWWRVEKHEEPKHPKGFPLERLIGECCPDDIESVAEGVVKTLEKIVSEYKLTVLVGGKPTLPDYGVPTHDVFKRIAVDDFKKFYDQVKDGAALARRAYDSQDRTESGNLWRELFGSKFPKPPENGGGSSGSGRGYTPPTGPATPGSGRFA

SEQ ID NO: 3986 - protein, 378 aa, Comamonadaceae bacterium; identical to SEQ ID NO: 3985

SEQ ID NO: 3987 - protein, 379 aa, Stigmatella aurantiaca
MELPTDFKEFLQEIRPTENQRSDLQTGHKTLRERLLADEDLKKCFISDFLQGSYRRATAIRPKGDRRSDVDIIVVTRLSEREYTPAKAMDLFKPFLDKHYKRKWRQQGRSFGIELSYVELDLVLTSAPSEAEVGILRSDAVTSDDDLEEAKDWRLHRSWVALGSRYRSDAKNLLAEAKGQDEWRAQPLHIPDRDADKWEPTHPLAQIAWTRDKNARTDGHFVNVVKAIKWWRVENYEEPKHPKGFPLERLIGECCPDGITSVAEGIVKTLEKIVSQYALTVLAGGKPILPDYGVSTHDVFKRISAEDFKKFYDQAKTGADLARRAYASEDRTESGNLWRELFGRKFPKPPESGGGTGGSSRGGFTPPTGPAVPGSGRFA

SEQ ID NO: 3988 - protein, 375 aa, Cobetia sp.
MILQSDFNKFLQEIRPTKAMRDQLIKGHKTLRERLNEDEELKPILVSDFLQGSYRRYTAVRPKGDKRSDVDLIIVTKLDETEYTPKKAMALFEPFLNKHYRGKWRPQGRSFGIEMSYVDLDIVPTSAPARQEYGILQSDAVTSDDDIFEARDWRLHRSWLALHNRSRIDARSLLDQAASEAEWQAKPLRIPDRDADEWDDTHPLEQIRWTRDKNSRCNGHFVNVVKCIKWWRLEHYADPVHPKGFPLERLIGEHCPDGLGSVAEGVVKTLEAIVSSYSVLVLAKGKPTLPDYGVPSHDVFKRITGKDFCTFYDQVKTGAELSRRALDSEDRTESGNLWCEMFGSKFPEPPNNGSGKKGGFTPPIGPAAPGTGRFA

SEQ ID NO: 3989 - protein, 375 aa, Kushneria avicenniae
MILQSDFNKFLQEIRPTKPMRDQLISGHKTLRDRLNADEDLKPIMVSDFLQGSYRRHTAVRPKGDKRSDVDLIIVTKLDETEYTPKKAMDLFEPFLNKHYNGKWRPQGRSFGIEMSCVDLDIVPTSAPAKQEYGILQSDAVTSDDDIFEARDWRLHQSWLALHNRSRIDANLLLDQAASEAEWQAKPLRIPDRDADEWDDTHPLEQIRWTRDKNLRCNRHFVNVVKCIKWWRLEHYAAPAHPKGFPLERLIGEHCPDGIESVSEGVVKTLEAIVSSYSFLVLIENKPTLPDYGVPSHDVFKRITREDFCTFYDQVKTGADLSRRAFDSEDRTESGNLWREMFGSKFPEPPNNGSGKKGGFTPPTDPATPGTGRFA

SEQ ID NO: 3990 - protein, 383 aa, Desulfatibacillum alkenivorans
MELPTDFKSFLTAIRPTENQRSELKTGHTTLRSRLKDFQELKDVYISDFLQGSYRRATAVRPKGEKRSDVDIIVVTKLHEEEYTPDAAMDIFVPFLDKYYKDKWQRQGRSFGISLSYVDLDLVITSAPSEAEIGALQSESVTSETDIAEAKDWRLHPSWLSSDSRWLVENAQELLAKAKSESEWKLSALRIPNREAGNWEDTHPLMQIQWTRDKNASTNYHFVNVVKALKWWKIENYDEAKHPKGFPLERIIGDCCPDGITSVANGIVTTLESIVSNYMAYSITNSKPILPDYGVPGHDVLGRLSSEDFNIFYNQAEEGAKIARRAYDSQDRNESGNLWRKLLGSKFPAPPDNGGKAKAGYTTPAAAAAPGGGRFATTGEYLD

SEQ ID NO: 3991 - protein, 376 aa, Candidatus Gracilibacteria bacterium
MILSSDFKTFLSKIRLTPTQKEELKNGHTLLRSRLNSFEELQDIFVSDFLQGSYRRHTAVRPKNGKRSDVDIIVVTKLHESEYSPEEAMNVFTPFLDKYYEGKYERQGRSIGIALSAVEFDLVLTSAPSASELEILKSAAVTTEDTIEEAFDWKLHPAWLAMGSREANQFTEQRLNQASSEQEWKTNPLRIPNCEAQCWKDTHPLEQIKWTRDKNQITSGHFINVVKAIKWWRLTNYDEPKHPKGFPLERIVGDCCPDDIDSVADGVVRTLETIVSKYKDLVDRKEKPTLPDYGVPDHDVLARMDAEDFCKFYEQSKEAALLARHAFDSTDRVESGKLWQQLLGKEFPDPPENGGNKSAGYTNPIAPASPDSGRFA

SEQ ID NO: 3992 - protein, 376 aa, Chloroflexi bacterium
MELTNDFSEFLKEIRPTQTMLTNCKDGHTLLRDRLEAEESLQDCYVSDFLQGSYRRSTAVRPKGDQRSDVDIIVVTNLSEEKYTPKKAMAIFEPFLEKYYKDKWRPQGRSFGIELSTVDMDLVITSAPSEIDIENLKSEAVRTSDSVVSAPDWRLTPSWLSLRSREFNFSAKALLELSSKQEEWKLSPLRIPDRDAGIWEDTHPLEQIRVTRDLNKNTNFHFVNVVKSIKWWWLDQLEDPQPPKGFPLERLIGECCPIGITSVAEGITRTFETIISLYGYHVSNSTKPVLPDYGVTSHDVFKRVTPEEFATFYGLVQPAALLAREAFNSTDRTESGNLWRELLGNKFPKPPDNGGSKGQGYTPPDAPAVPGTSRYA

SEQ ID NO: 3993 - protein, 367 aa, Myxococcus xanthus
MALPLPTYFEDFLQGIRPTAAQRQDMITGHSTLKERLLADEKLSPGFVSLFLQGSYKRRTAVRPKDGKRADVDLIVVTRMKESEFTPAQAMACFKPFLDQHYAGKYRQQGRSFGIELSYVEMDLVITAAPSEAEAGVYSELAKSEGQLRADEDTDQSLLKVVEESASLWRSQRLRIPDRDAGAWQDTHPLAQLTWTSQKNARCSRHFVNVVKALKWWRLVHLDELPERPKSYPLEHLIGDCCPDGITSVAEGVVRTLENFAQRYAIHAAAHQSPHSPDRGVDQNVMARISGSDFAKFHAQVVKASQTARQAFDAPDAQAAAPLWRELFGDKFPNAPDAGGGGSPSKGGFSKHEGGPGTVGGGRFARE

SEQ ID NO: 3994 - protein, 364 aa, Hyalangium minutum
MTLPLPTYFADFLQDIRPTKAQRAEMIDGYSRLKERLQSDAQLKTGFVSMFLQGSYKRRTAVRPKDGKKADVDLIVVTRMKESEFTPAEAMACFRPFLEKYYHDKYRQQGRSFGIVMSTVEMDLVITAAPVEAEAGVYSAFAKSEDVLQIEEDESQPIVKTDSNGNPQWKSEPLRIPDRDLGAWQDTHPLVQLSWTSQKNARCSGHFVNVVKALKWWRLVHAGALPDRPKSYPLEHLIGDCCPDGISSVAEGVVRTLERFTQSYALHAANTHAPYAPDRGVDQNVMARISGDDFAKFHAQVAAAAKKARQAFEAPDAQTAAPLWRELFGDKFPRAPEPGRGSPPQGNFTPHQGGPGMVGSGRFA

SEQ ID NO: 3995 - protein, 367 aa, Coprococcus comes
MAQKMTTYFNDFLKNIRLTENQVSELKAAHTTLRRRLEADEDLKDIVETTFLQGSYRRATAVRPRQGKRSDVDIIVVTKLDKETVTPEEALDIFEPFLKKYYDGKYRKQGRSWGIEMTHVDLDVVPTSAPSLAEQGLLENMAVLSDDDLEEMNEKAESLEKSFSSDLWNFAFAEFMKADENADWKKEPLYIPDREAEFWDKTHPLEQIRWTQEKNAKCNKHYVNVVKCIKWWRKEKYPDVKHPKSYPLEHFIGDCCPDSIESVAEGIVLTLEKIVSDYPTKPILEDRGVPEHDVFGRLSDEDYEAFYDDVCEAAIIARSAYEAETVAESASLWRELFGNKFPEAKVKETVFTKRESASTNLTGGRFA

SEQ ID NO: 3996 - protein, 363 aa, Coprococcus comes
MTTYFNDFLKNIRLTENQVSELKAAHTTLRRRLEADEDLKDIVETTFLQGSYRRATAVRPRQGKRSDVDIIVVTKLDKETVTPEEALDIFEPFLKKYYDGKYRKQGRSWGIEMTHVDLDVVPTSAPSLAEQGLLENMAVLSDDDLEEMNEKAESLEKSFSSDLWNFAFAEFMKADENADWKKEPLYIPDREAEFWDKTHPLEQIRWTQEKNAKCNKHYVNVVKCIKWWRKEKYPDVKHPKSYPLEHFIGDCCPDSIESVAEGIVLTLEKIVSDYPTKPILEDRGVPEHDVFGRLSDEDYEAFYDDVCEAAIIARSAYEAETVAESASLWRELFGNKFPEAKVKETVFTKRESASTNLTGGRFA

SEQ ID NO: 3997 - protein, 369 aa, Sedimentibacter sp.
MAQKMTTYFKDFLREIRLTDKQVEELKSAHSTLRNRLQTDEGLSDIIETTFLQGSYRRSTAVRPKNGTRSDVDIIIVTKIDRNEVTPEEALDKFEPFLKKFYDGKYRKQGRSWGIEMTHVDLDVVPTSAPSIAEAELLKNMAVLSDDDIIEMTEKAENILKSYHSSNLWYTNYQEIFHAGKEADWKSEPLYIPDREADSWEKTHPLEQISWTQQKNARCNGHYVNIVKCLKWWRKEKYPDIKNPKSYPLEHFIGDCCPDGIESIAEGITLTLETIASDYQQKPFLADRGVPEHDVFARLTDEDYEAFYEAVCDAAIIARKAYDAETIEESATYWQLLLGNKFPSPPSKSSNVFTKREGASSEISGGRFA

SEQ ID NO: 3998 - protein, 365 aa, Sedimentibacter sp.
MTTYFKDFLREIRLTDKQVEELKSAHSTLRNRLQTDEGLSDIIETTFLQGSYRRSTAVRPKNGTRSDVDIIIVTKIDRNEVTPEEALDKFEPFLKKFYDGKYRKQGRSWGIEMTHVDLDVVPTSAPSIAEAELLKNMAVLSDDDIIEMTEKAENILKSYHSSNLWYTNYQEIFHAGKEADWKSEPLYIPDREADSWEKTHPLEQISWTQQKNARCNGHYVNIVKCLKWWRKEKYPDIKNPKSYPLEHFIGDCCPDGIESIAEGITLTLETIASDYQQKPFLADRGVPEHDVFARLTDEDYEAFYEAVCDAAIIARKAYDAETIEESATYWQLLLGNKFPSPPSKSSNVFTKREGASSEISGGRFA

SEQ ID NO: 3999 - protein, 369 aa, Unknown
  Description of Unknown: uncultured Eubacterium sp. sequence
MSTVPSYFKDFLSNIRLSDNQVKDLKTGHTTLRRRLEEDETLSKIIISTFLQGSYRRSTAVKPKNGNKSDVDVIVVTKLDSEEYTPEEALDLFVPFLEKHYKDKYRIQGRSIGISLSYVDLDIVPTSAPSESETGVLQDEAIISEYTIEDFQQKLLTKSFNNDLLESAYNIFYKSDNEPQWKSEPLLIPDREAEKWDKTHPLEQIRWTVEKNKNCNTHYINVVKALKWWRKTQYPDMKHPKSYPLEHFIGDCCPDDIKSVAEGVVLTLENIVSQYTNKPFLADRGVPEHDVFARITDEEYSDFYDTVCDAAKIAREAFDCEELYDSVCKWRELFGNEFPPAPKPSKSNSSTGFTTRTEKSAAIPEGRFA

SEQ ID NO: 4000 - protein, 369 aa, Enterococcus cecorum
MSIVPSYFKDFLSNIRLSDNQVNDLKTGHTTLRKRLEEDETLSKIIISTFLQGSYRRSTAVKPKNGNKSDVDVIVVTKLDSEEYTPEEALNLFVPFLEKHYKDKYRIQGRSIGISLSYVDLDIVLTSAPSESETGVLQDEAIISEYTIEDFQQKLLTKSFSNALLESTYNIFCRSDSQPQWKSEPLLIPDREAEKWDKTHPLEQIRWTVEKNKNCNTHYINVVKALKWWRKTQYPDMKHPKSYPLEHFIGDCCPDDIKSVAEGVVLTLENIVSQYTNKPFLADRGVSEHDVFARITDEEYSDFYDTVCDAAKIAREAFDCEELYDSVCKWRELFGNEFPPAPKPSKSNSSTGFTTRTEKSAAIPEGRFA

SEQ ID NO: 4001 - protein, 369 aa, Robinsoniella peoriensis
MSTVPSYFKDFLSNIRLSENQVNDLKTGHTTLRRRLEEDETLSKIIISTFLQGSYRRSTAVKPKNGNKSDVDVIVVTKLDSEEYTPEEALDLFVPFLEKHYKDKYRIQGRSIGISLSYVDLDIIPTSAPSESETGVLQDEVIISEYTIEDFQQKLLTKSFDNDLLESAYNIFYKSDNEPQWKAEPLLIPDREAEKWDKTHPLEQIRWTVEKNKNCNTHYINVVKALKWWRKTQYPDMKHPKSYPLEHFIGDCCPDDIKSVAEGVVLTFENIVAQYTNKPFLADRGVPEHDVFARITDEEYSDFYDTVCDAVKIAREAFDCEELYDSVCKWRELFGNEFPPAPEPSKSNSSTGFTSRTEKPAAIPEGRFA

SEQ ID NO: 4002 - protein, 369 aa, Desulfitobacterium hafniense
MSTVPSYFKDFLSNIRLTDNQVSDLKTGHTTLRKRLEEDEVLSKIIISTFLQGSYRRSTAVKPKNGNKSDVDVIVVTNLDSEEYTPEEALNLFVPFLDKHYKDKYRIQGRSIGISLSYVDLDIVPTSAPSESETGVLQDKAIISEYTIEDFQQKLLTKSFDNALFESTYNVFCKSDEEPQWKSEPLLIPDREAEKWDKTHPLEQIRWTVEKNKNCNTHYINVVKALKWWRKTQYPEIKQPKSYPLEHFIGDCCPDDIKNVAEGVVLTLENMVAQYPDKPFLADRGVPEHDVFARITNEEYSDFYDTVCDAAKIAREAFDCEELYDSVCKWRELFGNEFPSAPEPSKSNSSTGFTARSEKSTAVPVGRFA

SEQ ID NO: 4003 - protein, 345 aa, Clostridium saccharoperbutylacetonicum
MWTLATYFNDFLKEIRLTTNQQNDLITGHTTLSDRLKKDEDLKDIIVSMFLQGSYKRSTAVRPKNNNKSDVDLVVVTNLNKDEKTPQDAIDLFTPFMDKYYKDKYRIQTKSIGIELSYVDLDVVITSAPSEVEKELIENSFMQSTDELIDIDDSDTTDWKSEPLYILNTKTEEWEETDPIAQIKWTIEKNKNCNGHYVNVVKSLKWWKKHTDKDNNAPKSYPLEHFIGYCCPDGIESVAEGIVYSLENIVANHSTKPVLDDHGVPTHDVFERITEDEYSEFYELVKDAAATARKALDASNKSTAIEEWKKLFGSKFPDDKTSNSSANMSFTERSSVSEIKPERYA

SEQ ID NO: 4004 - protein, 367 aa, Bacillus lehensis
MAKIPTYFKDFLKDIRLTKNQISDLIKGHKTLCDRLNADEDLSDQIVSIFLQGSYRRATAVRPKDGKRSDVDVVVVTNLDKEQVTPKEAHDLFEPFLEKHYKGKYRVQGRSIGIELSYVDLDLVVTSAPSEIQKEMLQNNGVITNYNLEDLDNWIYKSEQFDSDSKPESLVYFEKFVQASWKTEPLFIANREANKWDPTNPLEQIQWTWDKNKSCNSHYVNVVKALKWWRRVSDLGGNYPKSYPLEHLIGVCCPDGIDSIASGVTETLETIVTDHPTKPVLPDHGVPEHDVFERLTEEEYETFYEKVKEAANLAREALDADSVNESATKWRELFGNKFPEPPKPAKTESSSFTERVNKTHIGGNRFA

SEQ ID NO: 4005 - protein, 368 aa, Bacillus sp.
MGKLVTYFNDFLADIRLTGNQVDDLITGHTTLRNRLKADEDLSKIIVSTFLQGSYRRATATRPKSGKRSDVDVVVVTNLDKEQYTPEEAHDLFIPFLDKHYKDKYRIQGRSLGIELTYVDLDLVVTSAPSESQQELLEDENFTTDYSIEDLFDNVSSRSSSPSEDALSKSLTLFEKSVNEAVWKTEPLFIPNREAEKWEPTDPLAQIKWTWDKNKNCNKHYINVVKALKWWRRVDDPDGNHPKSYPLEHLIGQCCPDGIGSVAEGVTLTLEAIVAEHPTKPEMPDHGVPEHDVFERLTDEEYDAFYERVKEAAKIAREALDAESVYESAMGWRKLFGSKFPEPPEPKDKKNGFTEREQKTTIGGNRFA

SEQ ID NO: 4006 - protein, 371 aa, Bacillus cereus
MAKIPTYFNDFLSDIRLTEKQVDDLITGHTTLRDRLNEDENLSPIIVSTFLQGSYRRATAVRPKNGKRSDVDVVVVTRLDKDEYTPEEALNLFVPFLEKHYKDKYRIQGRSLGIELSYVDLDLVITAAPSESQIGILEAESVKTDFSIEDLNTWTLTKSWSFSSQNQSNPFVFLEAASEEPEWKTEPLLIPDREAEEWKPTDPLAQIKWTWNKNKKCNKHYVNVVKALKWWRRVDDPDGAHPKSYPMEHFIGECCPDNISSVAEGVTLTLEKIVSDYEIKPNLPDHGVTEHDVFGRLTDEEYEAFYERVVEAAKIAREAFDAEGVTESANLWRELFGNKFPKPKVESNSIEKNSGFTPRSEVTTIGGNRFA

SEQ ID NO: 4007 - protein, 371 aa, Bacillus cereus
MAKLSTYFSDFLSNIRLTEHQITDLITGHKTLRDRLNGDETLSPIIVSTFLQGSYRRATAVRPKNGKRSDVDVIVVTRLDKDEYTPEAALDLFVPFLEEHYKDKYRIQGRSIGIELSYVDLDLVVTAAPSESQIGILEADSVKTDFSIENLNNWTLTKSWSISEQDQVNPFILAESASNEPEWKTEPLLIPDREAEEWKPTDPLAQIKWTWDKNRECNKHYVNVVKALKWWRRVDDPDGNHPKSYPMEHFIGECCPDNINSVAEGVTLTLEKIVSDYKVKPYLPDHGVPEHDVFGRVTDEEYKVFYDRVVEAAKIAREAFDAEEITESANLWRELFGNKFPKPKVESNSIEKNSGFTPRSEVTTIGGNRFA

SEQ ID NO: 4008 - protein, 371 aa, Unknown
  Description of Unknown: Bacillus cereus group sequence
MAKLSTYFSDFLSNIRLTEHQITDLITGHKTLRDRLNGDETLSPIIVSTFLQGSYRRATAVRPKNGKRSDVDVIVVTKLDKDEYTPEEALDLFVPFLEEHYKDKYRIQGRSIGIELSYVDLDLVVTAAPSESQIGILEADSVKTDFSIENLNNWTLTKSWSISEQDQVNPFIFAESNSNEPEWKTEPLLIPDREAEEWKPTDPLAQIKWTWDKNRECNKHYVNVVKALKWWRRVDDPDGNHPKSYPMEHFIGECCPDNINSVAEGVTLTLEKIISDYKVKPYLPDHGVPEHDVFGRVTDEEYEVFYDRVVEAAKIAREAFDAEEVAESANLWRELFGNKFPKPKVESNSIEKNSGFTPRSEVTTIGGNRFA

SEQ ID NO: 4009 - protein, 357 aa, Bacillus sp.
MEVKTYFNDFLSNIRLTENQEKNLKSGHSILRRRLLEDEDISSIIVSTFLQGSYRRATAVRPKNGNKSDVDVIVVTNLNADDYTPQEALDLFIPFLDKYYGEKYTMQGRSIGIELSYVELDLVITSAPSESQKEILTTESILTSYSIDELENWSLSKSWSVNNQQADEPAWKTEPLLIPDRDADKWEKTDPLAQIKWTWNKNATGNRQYVNVVKALKWWKKLNPDPKYPKGYPLEHLIGSCCPDGIESVAKGVTFTLENIVLEYPQKPILKDHGVPEHDVFKRITDEEYEKFYKLITGAASLARQALDSPDKVESIEMWRELFGSKFPEPPASVKKSQNGFTARTEQTSSVSGGRFG

SEQ ID NO: 4010 - protein, 359 aa, Bacillus megaterium
MEVKPYFTDFLSNIRLTKNQTDDLKTGHKTLRKRLLEDESISPFIITTFLQGSYRRATAVKPKNNNKSDVDVIVVTNLDSEEYTPQQALDLFIPFLDEHYSGKWKMQGRSIGIELSYVELDLVITSAPSEAQKELLESESVCISESLEELSHWKLTKSWSFSNESSKEEAAWKSEPLLIPDREANKWEETDPLAQIKWTWDKNAACNSHYVNVVKALKWWKKLNPDPKYPKGYPLEHFIGNCCPDNISSVAKGVTLTLENIVSDHPSKPELKDHGVPEHDVFKRITDEEYEEFYNLVSNAASLAREALDCEDKVDSINLWRELFGSKFPEPPSNVTTSQNSSFTKREEPSSSVSGGRFG

SEQ ID NO: 4011 - protein, 353 aa, Planococcus kocurii
MEVKSYFNDFLLGIRLTDNQINDLKKGHSILRKRLLEDGELSSILVNTFLQGSYRRATAVRSKNGNKSDVDVIVVTTLDTEQYSPQEALDKFVPFLEKHYKGKYKMQGRSIGIELSYVELDLVITSAPSETQKELLTTNSISTSYSIEDLENWALTKSWSIDYQKEWKTEPLLIPDREAGKWEKTDPLAQIKWTWNKNADCNRNYVNVVKALKWWKKLNPNPKYPKGYPLEHFVGLSCPDGIGSIAEGVTLTLENIVKEYPEKPFLKDHGVPEHDVFKRISDEEYKEFYDLVIEAALIARKALDSTDKVESIELWRELFGSKFPEPPSNTKKSQDSFTPRTEPTSSVSGGRFG

SEQ ID NO: 4012 - protein, 364 aa, Unknown
  Description of Unknown: uncultured Oscillibacter sp. sequence
MSAIQTYFQDFLTNIRLPDSLKKALISAHTELREQLKSDDLTKDLLVESFLQGSYARSTCIKPAPGKKVDVDVIVVTNIDHDTVSAQEAFAIITPFVKKYYQNYEQQKRSIGISLPEVDMDLVITAAPSEEVKRAIECAGLSSAFTVDDLSGYQQSLLENYRLDSLERFFESDSTGQQWRAEPLLIPDNVENQWYRTHPLEQIRWTKRKNQICKGNYVNVVKAIKWWRRLELPSLKHPKSYPLEHFVGECCPDGITSVAEGIVGTLECIAECYPKKPFLPDRGVPEHDVFEMLSDEDYDTFYKAVCGGARLARAAYDSADIEESVNLWKSFFKDCDEFPSYYRKNGGFTPRVQESKGVPVGRFG

SEQ ID NO: 4013 - protein, 353 aa, Candidatus Peribacteria bacterium
MDLPTYFTDFLKNIRPEPDDLDEFRAAHKELREKLEADLGLSDIILSTFLQGSYRRATAIRPKPGKKGDVDVVVVTDIDKEQKTPQQALDTFKPFLDKHYKGKYVIQGRSIGISLTRVDLDLVATSAPSEVEKSVWKSMSFTEDRTLEDEEFVEKMTRASAEWKLSPLEIPDREAKLWVPTHPLKQIQATQEKNARCNKHFVNVVKAIKWWRRKFVTPEYPRSYPVEHLIWHCCPDQIKTVAQGVTETLETIVRDHKLKPFLPDHGVPQHDVFKRIIQKDYDEFYKQVAEAAVLARKALDEQDTEKSAKLWRELFGNDFPPYGGGTGGGSNGGSKGGYTPRDRPSNVGGARFG

SEQ ID NO: 4014 - protein, 368 aa, Paenibacillus sanguinis
MKLPTYFSDFLSDIRLTKNQVNDLIKGHKTLRERLETDDLLSTIIVSTFLQGSYRRSTAVRPKSDQRSDVDVIVVTKLDKDEYTPEEAMEVFKPFMEKYYKDKYRFQGRSIGIELSYVDLDVVITSAPSEAETGVLENESVEADSTIEELELIVKSLSANQYNSEVQGFLAFANNEAEWKTSPLHIPDRSVQEWKETHPLEQIRWTWNKNASCNGHYINVVKALKWWKRVNDPDNHPKSYPLEHLLGQTCPDDISSVAEGVTLSLEAIVADYPEKPFLSDHGVPDHDVFARITDEEYEAFYQNVQTAAIIAREALDATTVKESANKWRELFGTKFPPPPADTNSTDSSSVGGFSSRTEKSTPGGGRFA

SEQ ID NO: 4015 - protein, 366 aa, Paenibacillus sp.
MKLTTYFNDFLSNIRLTKNQVDDLIKGHKTLRERLEGDDTLSKIIVSTFLQGSYRRSTAVKPKSDQRSDVDVIVVTKLVKDDYTPDEAMKVFEPFMEKYYKGKYRYQGRSIGIELSYVDLDVVITSAPSEAEEGILETESVETNSTIEELEAIVKSYSAYQYNSEVRGFLAFANNEPEWKTSPLHIPDRSVEEWKETHPLEQIRWTWNKNASCNGHYINVVKALKWWKRVNDPGNHPKSYPLEHLIGQTCPDHITSVAEGVTFALEAIVSNHPTKPFLADHGVPEHDVFARITDEEYDTFYKKVQTAATIARQALDAVTVKESANKWIELFGSKFPSPPADTSTNSSSNGFSSRIEKTTPGGGRFA

SEQ ID NO: 4016 - protein, 374 aa, Unknown
  Description of Unknown: Paenibacillus sequence
MNIPTYFARFLKEIRLTENQVNDLIKGHTTLRKRLKEDEDMSKIIVSTFLQGSYRRSTAVRPKGDSRSDVDVILVTKLSMEEYSNPEDAINVLKPFMEKHYAGKYQIQGRSIGISLSYVDLDVVITAAPSESEEGILESASVTDMRALEDIETWSLKGSWEVLNETIETSSIFKTYSNANEPEWKTVPLWIPDRDAEEWKQTDPLAQIKWTQEKNKSCNRHYVNVVKALKWWRRINNVPKHPKGYPLEHLIGLCCPDGIQSVGQGVTEVLEAIVNNYSTKPVMSDHGVPEHDVMGRITEEEYGEFYELVKKAAEIARKASDATTVKESAEEWNKLFGSKFPTSEATTANNQSSSLVFSKRESPISSDIVGGRFG

SEQ ID NO: 4017 - protein, 374 aa, Paenibacillus odorifer
MNIPTYFARFLKEIRLTENQVNDLIKGHTTLRKRLKEDEDMSKIIVSTFLQGSYRRSTAVRPKGDSRSDVDVILVTKLSMEEYSNPEDAINVLKPFMEKHYAGKYQIQGRSIGISLSYVDLDVVITAAPSEREEGILESASVTDMRALEDIETWSLKGSWEVLNETIETSSIFKTYSNANEPEWKTVPLWIPDRDAEEWKQTDPLAQIKWTQEKNKSCNRHYVNVVKALKWWRRINNVPKHPKGYPLEHLIGLCCPDGIQSVGQGVTEVLEAIVNNYSTKPVMSDHGVPEHDVMGRITEEEYGEFYELVKKAAEIARKASDATTVKESAEEWNKLFGSKFPTSEATTANNQSSSLVFSKRESPISSDIVGGRFG

SEQ ID NO: 4018 - protein, 373 aa, Paenibacillus borealis
MNIPTYFARFLKEIRLTDNQVDDLIKGHTTLRKRLNEDEDMSKIIVSTFLQGSYRRSTAVCPKGDSRSDVDVIVVTKLSMEEYSNPEDAIKVFEPFMEKHYAGKYQIQGRSIGISLSYVDLDVVITAAPSESEEGILESTSVTDMRPLEDIETWSLKGSWKVLNETFEASSIFKTYSNANEPEWKTVPLWIPDREAEEWKQTDPLAQIKWTQEKNKSCNRHYVNVVKALKWWRRINNVPKHPKGYPLEHLIGLCCPDGIQSVGQGVTEVLEAIVNNYSTKPFMADHGVPEHDVMGRVTDEEYDEFYELVKKAAEIARKASDATTVKESAEEWNKLFGSKFRTSEATTTNQSSSGVFSKRENPTGSDIVGGRFG

SEQ ID NO: 4019 - protein, 373 aa, Paenibacillus donghaensis
MNIPTYFARFLKEIRLTDNQVDDLIKGHTTLRKRLNEDEDMSKIIVSTFLQGSYRRSTAVRPKGESRSDVDVIVVTKLSMEEYSNPEDAIKVFEPFMEKHYEGKYQIQGRSIGISLSYVDLDVVITAAPSESEEGILESASVTDMRALEDIETWSLKGSWEVLNETIEASSIFKTYSNANEPEWKTVPLWIPDREAEEWKQTDPLAQIKWTQDKNKSCNRHYVNVVKALKWWRRINNVPKHPKGYPLEHLIGLCCPDGIQSVGQGVTEVLEGIVNDYSTKPVMADHGVPEHDVMGRVTDEEYNEFYELVKKAAEIARKASDATTVKESAEEWNKLFGSKFPTSEATTNNQSSSGVFSKRENPTSSDIVGGRFG

SEQ ID NO: 4020 - protein, 373 aa, Paenibacillus glucanolyticus
MNIPTYFARFLKEIRLTENQVNDLIKGHTTLRNRLEEDEDLSKIIVSTFLQGSYRRSTAVRPKGDSRSDVDVIVVTKLSMEEYSNPEDALQVFVPFMDKHYAGKYEIQGRSIGISLSYVDLDVVITAAPSESEEGILESNSVTDMRALEDIETWSLKKSWEVLEETLDTSSVLRTYSNANEPEWKSVPLWIPDREAKEWKQTDPLAQIKWTQEKNKSCNRHYVNVVKALKWWRRSNDVPKYPKGYPFEHLIGLCCPDDIQSVGQGVTEVLEEIVNNHPTKPVMPDHGVPDHGVMGRVTNEEYEEFYQLIKEAAVIARRATDATTVKESAEEWNKLFGSKFPTSEATSKSENSSVGFSKRENPTTQNVMGGRFG

SEQ ID NO: 4021 - protein, 373 aa, Paenibacillus sp.
MNIPTYFARFLKEIRLTENQVNDLIKGHTTLRNRLEEDEDLSKIIVSTFLQGSYRRSTAVRPKGDSRSDVDVIVVTKLSMEEYSNPEDALQVFVPFMDKHYAGKYEIQGRSIGISLSYVDLDVVITAAPSESEEGILESNSVTDMRALEDIETWSLKKSWEVLEETLDTSSVLRTYSNANEPEWKSVPLWIPDREAKEWKQTDPLAQIKWTQEKNKSCNRHYVNVVKALKWWRRSNDVPKYPKGYPFEHLIGLCCPDDIQSVGQGVTEVLEEIVNNHPTKPVMPDHGVPDHDVMGRVTNEEYEEFYQLIKEAAVIARRATDATTVKESAEEWNKLFGSKFPTSEATSKSENSSVGFSKRENPTTQNVMGGRFG

SEQ ID NO: 4022 - protein, 374 aa, Paenibacillus kribbensis
MNIPTYFARFLKEIRLTGNQVNDLITGHTTLRNRLEEDEEMSKIIVSTFLQGSYRRSTAVRPKGESRSDVDVIVVTKLSMEEYSNPEDALQVFVPFMEKHYAGKYKIQGRSIGISLSYVDLDVVITAAPSESEEGILESNSVTDARALEEIETWTLKKSWAVLGETLDSSSVWKTYSNANEPEWKSVPLWIPDREAKEWKQTDPLAQIKWTQEKNKSCNRHYVNVVKTLKWWRRLNHLPKYPKGYPFEHLIGLCCPDDIGSVGQGVTEVLEAIVNDHPTKPFMADHGVPSHDVMGRVTDEEYDEFYKLIQEAAVIARKATDATTVKESAEEWNKLFGSKFPTSEATTDMDNRVSVGFSKRDNPTTPNIVGGRFG

SEQ ID NO: 4023 - protein, 374 aa, Paenibacillus sp.
MNIPTYFARFLKEIRLTGNQVNDLITGHTTLRNRLEEDEEMSKIIVSTFLQGSYRRSTAVRPKGESRSDVDVIVVTKLSMEEYSNPEDALQVFVPFMEKHYAGKYKIQGRSIGISLSYVDLDVVITAAPSESEEGILESNSVTDARALEEIETWTLKKSWAVLGETLDSSSVWKTYSNANEPEWKSVPLWIPDREAKEWKQTDPLAQIKWTQEKNKSCNRHYVNVVKTLKWWRRLNHLPKYPKGYPFEHLIGLCCPDDIGSVGQGVTEVLEAIVNDHPTKPFMADHGVPSHDVMGRVTDEEYDEFYNLIQEAAVIARKATDATTVKESAEEWNKLFGSKFPTSEATTDKDNRASVGFSKRDNPTTPNIVGGRFG

SEQ ID NO: 4024 - protein, 384 aa, Synechocystis sp.
MELPSYFIDFLSNIRPTDNQVDDYIRGHRTLSKNLLADPLLAPIIVAIILQGSYRRATAVKPKSGKRADVDVIVVTKLNQQDYLNPESAFNPFIPFLNKYYQDKFELQGRSVGITLSYVDLDLVITSAPSESEIGILKSDSVISQDTPENVNDWRLVPSWISLESRSTMPTQLMQSRLNNAKKEAEWKLSPLYIPDRDAKVWVPTHPLAQIQWTWDKNRLCNGHYINVVKALKWWRRVNHLTPKYPKGYPVEHLIGQCCPDGICSVAEGVTKTLEKIASSYKVYAASKTAPDLRDHSVPTHNVFKRVSGEDFAEFHNQVCTAAKVARDAIDADTVYESAENWRILFGQEFPKAPNDNSGRTLGPNPGGFTQRSNISILGGGRFA

SEQ ID NO: 4025 - protein, 386 aa, Nostoc sp.
MELPSYFNDFLAAIRPQGNHVDDYKTGHKTLRQRLKEDAVLSSIITTTFLQGSYRRATAIRPQGEKRADIDIIVVTKLSEDEYTPKNALELFVPFLEKHYKGKYKPQGRSFGIELSYVDLDLVITSAPSESEIGIFSTDSIISDDTPETAEADEDWRLVPSWVSVETRSVISFSEKKYRLDTARTEAEWKISPLRIPDRDTQQWQDTHPLEQIRWTWDKNRRCNKHYINVVKGMKWWRRINHPTPKYPKGYPVEHLIGQCCPDGISSVAEGVTKTLETIAEKYQGYASYKMTPNLSDHGVPSHNVFKRVSGEDFAEFHSQVCEAAKIARLAYNATDIPTSVAYWQKLFGKKFPDAPPNSGNGGKNPTGGGYTPRQDVTQLGGGRFA

SEQ ID NO: 4026 - protein, 385 aa, Zavarzinella formosa
MNVPTYFNQFLSKVRLTPNQVSDCRTGHMTLRNRLMDDDTLAPIIVNTFLQGSYRRATAVRPKDDKRADVDVIVVTKLDRSEYRNPEDALKLFEPFLEEHYAGKWEPQGRSFGIKLGYVDLDIVPTAAPSVSEYGVLAKASLADDETPDGVTNASAMPWWLSLGGDRAVHYSQSFAEAVRQDPEWKLEPLYIPDRDVKEWVPAHPLEQIRWTWNKNARCNGHYVNVVKALKWWRRVNHPTPQYPKGYPVEHIIGQNCPDGISSAAEGVTQTLENVQAAYGVYIRLNMKPYLPDHGVPQHDVLKRVAASDFALFYEQVVAAAAIARRALNETSLSRSVAAWRELFGDRFPPPPDNDDDDSGGGGGSGQGGFSRRTTVSTVTGGRFA

SEQ ID NO: 4027 - protein, 337 aa, Deinococcus marmoris
MIMTSSFETFLSAIRPTATQRKAMRRGHRALRDRLNDDDKLWELTVATFIQGSYRRATAIRAAAGERSDVDVVVVTTIPQSTLAAEAQALFYDFAEKHYPKKWQKQGRSIGISLGDVDLDLVITSGPSEAQTEAVKSFSAFDTADLAGLDEERDYYGLNVGPVLLEQAKQAQWKQEPLYIPNRDLDCWDPTHPLAQIVWTRDKNAATAGHYINVVKALKWWKRNNPALPKHPKGYPLEHLIGQCCPSDITSVAEGITRTLEEMVRRYGSGTIVPFLPDHGVPSHDVLRRVKENPADFQVFMTEIAGAATLARQALDAATPKASADAWRELLGDKFPE

SEQ ID NO: 4028 - protein, 371 aa, Deinococcus marmoris
MIMTSSFETFLSAIRPTATQRKAMRRGHRALRDRLNDDDKLWELTVATFIQGSYRRATAIRAAAGERSDVDVVVVTTIPQSTLAAEAQALFYDFAEKHYPKKWQKQGRSIGISLGDVDLDLVITSGPSEAQTEAVKSFSAFDTADLAGLDEERDYYGLNVGPVLLEQAKQAQWKQEPLYIPNRDLDCWDPTHPLAQIVWTRDKNAATAGHYINVVKALKWWKRNNPALPKHPKGYPLEHLIGQCCPSDITSVAEGITRTLEEMVRRYGSGTIVPFLPDHGVPSHDVLRRVKENPADFQVFMTEIAGAATLARQALDAATPKASADAWRELLGDKFPESTSTSQAGLMSVAATPSLTFPSHPVAPKGPKGFA

SEQ ID NO: 4029 - protein, 401 aa, Spirosoma sp.
MSRKSSFNEFLANIRLTKSQRDDLIMGHKTLTRRLNNDEELSSVIVSTFLQGSYRRATAVKPKNNKRADVDIIVVTTLNKDELTPEEAINKFEPFVKKYYDGKYKINGRSIGIKLSYVDLDIVITSAPSEAAQKELRAESVTTEFSLEDLNNDWRLVNSWAEPNHRSYWSSLFEQSVRNAVEWKSEPLWIPDRDAKCWVQTNPLEQIRWTRDKNKNTNTHFINVVKAIKWWRTSKLTDLKYPKGYPIEHMVGDCCPDNITSVEEGIVKTLEGIVTIYSIDRILERTPILWDRGVDDHNVWKRVDPEDFVAFYDYVKDAAKTARKAFDSVKETDWHDNWRKLFGSEFPPVSEEQARAESLADKSNALRSGQAKVGQNVNIVFGGSGVSVPKERNHYDDKSLL

SEQ ID NO: 4030 - protein, 381 aa, Chryseobacterium sp.
MKINSYFNDFLSNIRLTSSQKEDLKRGHKTLRDRLNTDDELKDIIISTFLQGSYRRSTAVRPLNGKRADVDVIVVTNLDRNEITPQQAIEKFIPFVEKHYKGKYEIQGRSIGIELSYVDLDIVITSAPSESDRELLKSSSVTSSLMLEDFTNDYEWRLTKGWSDPDPMKSFNFLAESVKNQAEWKMEPLWIPDSEADSWDQTHPLEQIRWTRDKNKNTNKHFVNIVKALKWWRTLKLTDLKYPKGYPIEHMIGDCCPDGVTSVAEGVYKTLQGIVDTYSSERLWGTTPVLPDRGVPEHNVWKRVSNDDFISFYDSVEEYAALAKEALEAETLKEQVEKWREFFGDKFPSYDGDDTKNTLSSGSAGFTTRKENTDAGPGRFA

SEQ ID NO: 4031 - protein, 381 aa, Chryseobacterium camelliae
MKINSYFNDFLSNIRLTSSQKDDLKRGHKTLRDRLSADDELKDIIISTFLQGSYRRSTAVRPLNGKRADVDVIVVTNLDRNEITPQQSIEKFIPFVEKHYKGKYEIQGRSIGIELSYVDLDIVITSAPSESDRELLKSSSVTSSLMLEDFTNDYEWRLTKGWSDPDPMKSFNFLAESVKNQAEWKMEPLWIPDSEADSWDQTHPLEQIRWTRDKNKNTNKHFVNIVKALKWWRTLKLTDLKYPKGYPIEHMIGDCCPDGVTSVAEGVYKTLQGIVDTYSSERLWGTTPVLPDRGVPEHNVWKRVSNDDFISFYDSVEEYAALAKEALEAETLKEQVEKWKEFFGDKFPSYDGDDTKNTLSSGSAGFTTRKENTDAGPGRFA

SEQ ID NO: 4032 - protein, 381 aa, Elizabethkingia genomosp. 3
MKINSYFNDFLSNIRLTSSQKDDLKRGHKTLRDRLAADDELKDIIISTFLQGSYRRSTAVRPLNGKRADVDVIVVTNLDRNEITPQQAIEKFIPFVEKHYKGKYEIQGRSIGIELSYVDLDIVITSAPSESDRELLKSSSVTSSLMLEDFTNDYEWRLTKGWSDPDPMKAFNFLAESVKNQAEWKMEPLWIPDSEANSWDQTHPLEQIRWTRDKNKNTNKHFVNIVKALKWWRTLKLTDLKYPKGYPIEHMIGDCCPDGVTSVAEGVYKTLQGIVDTYSSERLWGTTPVLPDRGVPEHNVWKRVSNDDFISFYDSVEEYAALAKEALEAETLKEQVEKWREFFGDKFPSYDGDDTKNTLSSGSAGFTTRKENTDAGPGRFA

SEQ ID NO: 4033 - protein, 385 aa, Runella limosa
MKIDSYFSDFLSDIRLTSSQKEDLKRGHETLRRRLNEYDDLKSIIVSTFLQGSYRRATAVRPLNGKRADVDIIVVTNLDRYNLTPQEAINKFIPFCEKYYKGKYELQGRSIGIELSYVDLDIVVTAAPSEVDLAALKSRSVTTDLMLEDFGGNYEWRLSKGWSEPDFQKGYVYLSESVRSEPEWKINPLWIPDRDAEEWVETHPLEQIRWTRDKNKNTNGHYVNVVKAIKWWRTLRLTNLKYPKGYPIEHMIGDCCPDNITSVAEGVCKTMEVIIAKYQIQQLLGTTPVLPDRGVPTHNVWKRVSPHDFAEFYESVQEYSKIAREAFDAEKLKTQVTKWRELFGEKFPPYKGNEEEESKSRNLTAPLGGFTPRKESSDVTPKRFA

SEQ ID NO: 4034 - protein, 383 aa, Elizabethkingia miricola
MKIDSYFNDFLSNIRLTSSQKDDLKRGHKTLRERLNTDEDLKDIIISTFLQGSYRRSTAVKPVNNKRADVDVIIVTSLDRASVTPEEAIDKFIPFVEKHYEGKYEIQGRSIGITLSYVDLDIVITSAPSEADKAALQSNSVMSNLMLEDFSSNYEWKLSKGWSEPDLLKANIYLSEAVKAEAEWKTSPLWIPDREAEQWDQTHPLEQIRWTRDKNKNTNKHFVNVVKALKWWRTLKLTDLRYPKGYPIEHMIGNCCPDGISSVAEGVTKTLENIIDTYYLDYFFNRTPILPDRGVPEHDVWKRVSVDDFKSFYDSVKEYSALAKEAMEAESLKDQVNKWREIFGEKFPPYDDDDDDFEKNSNPPSGGFTSRKESSNVESGRFA

SEQ ID NO: 4035 - protein, 384 aa, Elizabethkingia miricola
MKIDSYFNDFLSNIRLTASQKADLITGHTTLRRRLLADEDLNDIIISTFLQGSYRRSTAIRPLNGKRADVDVIIVTNLDRESVTPEDAIEKFIPFVKKHYDGKYELQGRSIGIELSYVDLDIVITSAPSEVDKAALQSSSVLSSLMLEDFAPTYEWRLSKGWSEPDLQKANVYLSEAVKSEVEWKTSLLWIPDREAEQWDQTHPLEQIRWTRDKNKNTNKHFVNVVKALKWWRTLQLTNLKYPKGYPIEHMIGDRCPDGISSVAEGVSKTLEGIVDAYYMDYILDRTPILCDRGVPEHDVWKRVSVEDFKSFYDSVKEYSNIAKEALEAESLKEQVNKWRQIFGDKFPPYDDDDDDASGKNSITPSGGFTPRKENSDVESGRFA

SEQ ID NO: 4036 - protein, 384 aa, Flavobacterium sp.
MGNINSYFTDFLSGIRLTQTQKDDAKRGHTTLRNRLLADDDLKDIIVTTFLQGSYRRSTAVRPNGEKRADVDVIVVTTLDQSNTSPEEALEKFELFAEKHYKGKWVKQGRSIGISLSYVDLDIVVTSAPSEVDKSGLRSKSVTTDLTLEDLMTTSYDWRLSKGWNEPDMMKAVNYLSESVRAEAEWKLQPLWIPDRDADIWEETHPLEQIRWTRDKNKSTNGYYVNIVKAFKWWRTLRITDLKYPKGYPIEHMLGDCCPDGVTSMAEGVMLTFENFVDTFSTHRSLGIVPEFPDRGVPSHNVWHRITSDDFKTFYDHMKNYAEKAREAYDEKSLRKATEKWQEIFGPKFPLAPDDDDDGGTKNSGPTSFTPRSGITEPESSRFA

SEQ ID NO: 4037 - protein, 386 aa, Flavobacterium noncentrifugens
MGNINTYFSDFLTGIRLTTTQKDDAKRGHTTLRNRLLADEDLKDIIVTTFLQGSYRRSTAVRPLGEKRADVDVIVVTTLDRNKVNPKDALEKFEPFVEKYYKDKWERQGRSIGISLSYVDLDIVVTSAPSEADKTSLRSKSVTTDMSLEDLMTPSYDWRLSKSWSEPDIMKAYSQLSESVRAEAEWKLEPLWIPDRDADIWEETHPLEQIRWTRDKNKMTNGNYVNVVKALKWWRTLKVTDLKYPKGYPIEHMIGDCCPDDAKSIADGVVRTFENFVSNYSTNRAWGTVPKFPDRGVPSHDVWHRITSDDFITFYDHMKDYATKARDAYDETSLRKATEKWQDIFGTKFPLAPEDDDEDGGSNKGSGPSGFTPRTEVTEPGSSRFA

SEQ ID NO: 4038 - protein, 380 aa, Rhodopirellula baltica
MELPSYFTDFLSAIRPTDVQRNTMQKRHKELRDRLVADEELCPLIVSTFIQGSYRRFTANRPPSGSRCDVDVIAVTKMHEDEYTPEQALEKFRPFLVKHYKGKYQRQGRSWGINVDDDISLDLVPTSAPTEAEKQAMANARVFEWDFPDIPDLGDPLTYNNLILEGTGYQFDLFNKAASAPEWKNQPLRIPDRDADSWDDTHPLEQIRWTWEKSKLTNGHFVNVAKAMKRWRQMKQPKPKYPKSYPLEHMIGDCCPDGIQYVAVGVTETFEEMERRFRPYVNAGIKPQIWDRGVVGHDVLERVSFEDFSAFLDLVKNAADLAREALNADTVKESANLWRDLFGDEFPEPPDNGGGGSSKGGGGGYTPRVKKTTIDGGRFA

SEQ ID NO: 4039 - protein, 381 aa, Ochrobactrum intermedium
MELKSQFSEFLREIRPTDRQKESWKTGASTLRSRLSADEALSKIVVATFLQGSIRRSTAIRPTGDKRPDVDIVVVTDIDYHKTTPQQAMDKFVPFLERHYPGKWRPQGRSFGIELSYVDIDLVITALPTDPASRQAMERLYRSKSVLTDNTLEEDATWRLNERWQPTPFGTQPLALDDAPAGNWRPNPLFLPDRDVGNWGGRTHPLAQIQWTATKNRACNGHYVNLVRATKWWRQRNALRPARYPKGYPLEHMIGHALNDGTTSIASGFVQVLETMRDNWRIPAILGQVPELPDHGVPEHNVLKRLSAEDFGAFHTAISRAAGQAREALDSDDAQKSGELWQKLFGSKFPLPGPNGGDRKAGGFFIPPSQPAEPRRTDRFA

SEQ ID NO: 4040 - protein, 381 aa, Ochrobactrum intermedium; identical to SEQ ID NO: 4039

SEQ ID NO: 4041 - protein, 379 aa, Ochrobactrum intermedium
MELKSQFSEFLREIRPTDRQKESWKTGASTLRSRLSADEALSKIVVATFLQGSIRRSTAIRPTGDKRPDVDIVVVTDIDYHKTTPQQAMDKFVPFLERHYPGKWRPQGRSFGIELSYVDIDLVITALPTDPASRQAMERLYRSKSVLTDNTLEEDATWRLNERWQPTPFGTQPLALDDAPAGNWRPNPLFLPDRDVGNWGRTHPLAQIQWTATKNRACNGHYVNLVRATKWWRQRNALSLPRYPKGYPLEHMIGHALNDGTTSIASGFVQVLETMRDNWRIPAILGQVPELPDHGVPEHNVLKRLSAEDFGAFHTAISRAAGQAREALDSDDAQKSGELWQKLFGSKFPLPGPNGGDRKAGFFIPPSQPAEPRRTDRFA

SEQ ID NO: 4042 - protein, 379 aa, Sinorhizobium meliloti
MELKSQFGEFLREIRPTDRQKEDWKTGANTLRSRLSADKDLSEIVVATFLQGSIRRSTAIRPTGDKRPDVDIVVVTDIDYHKTTPQQAMDKFVPFLERHYPGKWRPQGRSFGIELSYVDIDLVITALPTDPASKQAMERLYRSQSVLTNNTLEEDATWRLNERWQPTPFGSQPLALDDAPTGNWRPNPLFLPDRDVGRWGRTHPLAQIQWTAAKNRACNGHYVNLVRATKWWRQQNALVLPKYPKGYPLEHMIGHVLENGTASIATGFVQVLESMRDTWQIPAMFGQVPELSDHGVPEHNVLKRLSAEDFRSFHAAISTAAGQAREALDSDDAQKSGELWQKLFGSKFPLPGPNGGDRKAGFFIPPSQPAEPRRTDRFA

SEQ ID NO: 4043 - protein, 379 aa, Ensifer adhaerens
MELKAQFTEFLREIRPTDRQKEGWKTGANTLRSRLSADKDLSAIVVATFLQGSIRRSTAIRPTGDKRPDVDIVVVTDIDYHKTTPQQAMDKFVPFLERYYPGKWRPQGRSFGIELTYVDIDLVITALPTDPASRQAMERLYRSKSVLTDNTLEEDATWRLNERWRPTPFGTQPLTLDDEPTGNWRPNPLFLPDRDVGDWGRTHPLAQIQWTAAKNRACNGHYVNLVRATKWWRQQNALILPKYPKGYPLEHMIGHVLKDGTTSIATGFVQVLESMRDTWQIPAVFGQVPELPDHGVPEHNVLKRLSAEDFKSFHAAISTAAGQAREALNSHDAQKSGELWQKLFGSKFPLPGPNGGDRKPGFFIPPSEPAEPPRTDRFA

SEQ ID NO: 4044 - protein, 385 aa, Neorhizobium galegae
MELKSQFNEFLREIRPTDRQKEDWKTGSNTLRSRLQADETLSPIVIATFLQGSVRRSTAIRPTGDKRPDVDVVVVTDIDYHKTTPQQAMDKFVPFLNKFYPGKWRPQGRSFGIELSYVDLDLVITALPTDPASRQAMERLYRSTSVLTNDTLEDDMSWRLNSRWQPTAFGNQPQLLDDEPTGNWRPNPLFLPDRDVGNWGRTHPLAQIQWTAQNNRICNGHYVNIVRSTKWWRQNAENMPKYPKGYPLEHMIGHVLLDGTSSMAAGIVQVFETMRDKWQFNAAWDMVPELADHGVPEHNVLKRLSSEDFKAFHAAITNAAGQARAALDEEDAQESGRLWQKLFGTKFPIPGPNGGDRKTGFFVPPTKAAEPVRTDRFASRTDRFA

SEQ ID NO: 4045 - protein, 381 aa, Mesorhizobium sp.
MNMELKPQFNEFLASIRPTDRQKEDWKGGASTLRARLDADQDLKGLVVATFLQGSVRRSTAIRPSGDKRPDVDIVVVTNIDYENTTPEQAMKKFVPFLDRHYEGKWRWQGRSFGIELSYVDLDLVITALPKDPESRAVMESLYRSNSVLTNLSVEEDPSWRLNRQWRPSELGEAASVLNDLAPSEWRPHPLYLPDRDVGEWGRTHPLAQIQWTAAKNRVCNGHYVKIVRSLKWMKQEGTEEFPKYPKGYPLEHMIGHVINDGTTSMAMGVVQVLESIRDTWEYAAQIGQVPVLPDHGVPEHDVLKRLPLEDFRAFHKAASEAASRARAALDSNDAQESAELWRSLLGTKFPLPGPRGGDRAPSVFNTPTKPAQPQTTQRFA

SEQ ID NO: 4046 - protein, 379 aa, Mesorhizobium sp.
MELKPQFNEFLASIRPTDRQKEDWKGGASTLRARLDADQDLKGLVVATFLQGSVRRSTAIRPSGDKRPDVDIVVVTNIDYENTTPEQAMKKFVPFLDRHYEGKWRWQGRSFGIELSYVDLDLVITALPKDPESRAVMESLYRSNSVLTNLSVEEDPSWRLNRQWRPSELGEAASVLNDLAPSEWRPHPLYLPDRDVGEWGRTHPLAQIQWTAAKNRVCNGHYVKIVRSLKWMKQEGTEEFPKYPKGYPLEHMIGHVINDGTTSMAMGVVQVLESIRDTWEYAAQIGQVPVLPDHGVPEHDVLKRLPLEDFRAFHKAASEAASRARAALDSNDAQESAELWRSLLGTKFPLPGPRGGDRAPSVFNTPTKPAQPQTTQRFA

SEQ ID NO: 4047 - protein, 380 aa, Pseudomonas sp.
MELKPQFAEFLAGIRPTTSQQEDWKVGSKTLRSRLESDEKLKDIVVATFLQGSVRRSTAIRPLGEKRPDVDVVVVTNLDYNRLTPKEAMDLFEPFLERYYKGKWRPQGRSFGIELSYVDLDLVITALPTDGSRRSLLEQLYRSQSVLTTNSLEEEASWRLNRSWTPPSGLLGNTTLFQDAPQEEWKPHPLFLPDRDAGKWGRTHPLAQIQWTAAKNRTCNGHYVNLVRAIKWWRQENAESLPKYPKGYPLEHMIGHVLADGTTSMATGLVQALESFRDTWSYYDLLNVVPTLADHGVPEHNVLARLPVEDFKAFYAAVCEAAKLARKALDSIDARESSQLWKDLLGSKFPLPGPKGGDRSNGGFTAPTHSAQPNKTERFA

SEQ ID NO: 4048 - protein, 380 aa, Pseudomonas stutzeri
MELKPQFAEFLAGIRPTPSQQEDWKVGSKTLRSRLESDEKLKGIVVATFLQGSVRRSTAIRPLGDKRPDVDVVVVTNLDYNRLTPKEAMVLFEPFLERYYKGKWRPQGRSFGIELSYVDLDLVITALPTDGPRRSLLEQLYRSQSVLTTNSLEEETSWRLNSSWTPPSGLLGNATPLQDAPQEEWKPHPLFLPDRDAGKWGRTHPLAQIQWTAAKNRACNGHYVNLVRAMKWWRQENAKSLPKYPKGYPLEHMIGHVLVDGTTSMATGLVQALESFRDTWSYYDRLNSVPTLADHGVPEHNVLARLSVEDFKAFYAAVCEAAKLARKALDSTDAQESGQLWQDLLGRKFPLPGPQGGDRSNGGFTAPNHSAQPDKTERFA

SEQ ID NO: 4049 - protein, 380 aa, Pseudomonas sp.
MELKPQFTEFLAGIRPTIRQQEDWKIGSKTLRNRLEADEKLKDIVVATFLQGSVRRSTAVRPLGEKRPDVDVVVVTNLDYNRLTPKEAMDLFEPFLERYYKGKWRPQGRSFGIELSYVDLDLVITALPSDGSSRSLLEQLYRSQSVLTTNSLEEEASWRLNRSWTPPSGLLGNAMLFQDAPQEEWKPHPLFLPDRDAGNWGRTHPLAQIQWTAAKNRACNGHYVNLVRAMKWWRQENAERLPKYPKGYPLEHMIGHVLADGSTSMATGLVQTLESFMSTWSSYNQLNIVPTLADHGVPEHNVLARLPIEDFKAFYAAVEEAAKLARKALNSTDAQESGQLWRDLLGSKFPLPGPRGGDKPNGGFTAPTQSAQPNTTERFA

SEQ ID NO: 4050 - protein, 380 aa, Unknown
  Description of Unknown: Pseudomonas sequence
MELKPQFTEFLAGIRPTIRLQEDWKIGSKTLRNRLEADEKLKDIVVATFLQGSVRRSTAVRPLGEKRPDVDVVVVTNLDYNRLTPKEAMDLFEPFLERYYKGKWRPQGRSFGIELSYVDLDLVITALPSDGSSRSLLEQLYRSQSVLTTNSLEEEASWRLNRSWTPPSGLLGNAMLFQDAPQEEWKPHPLFLPDRDAGNWGRTHPLAQIQWTAAKNRACNGHYVNLVRAMKWWRQENAERLPKYPKGYPLEHMIGHVLADGSTSMATGLVQTLESFMSTWSSYNQLNIVPTLADHGVPEHNVLARLPIEDFKAFYAAVGEAAKLARKALNSTDAQESGQLWRDLLGSKFPLPGPRGGDKPNGGFTAPTQSAQPNTTERFA

SEQ ID NO: 4051 - protein, 380 aa, Pseudomonas sp.
MELKPQFAEFLTGIRPTASQQEDWKVGSKTLRSRLEADLDLKDIVVATFLQGSVRRSTAIRTLGEKRPDVDIVVVTNLDYNRLTPKEAMDLFEPFLERYYKGKWRPQGRSFGIELSYVDLDLVITALPIDGSGHRLMEQLYRSQAVLTTNSLEEEGSWRLNRSWVPPSGLLGNAAPLQDAPIDEWKPHPLFLPDRDAGEWGRTHPLAQIQWTAAKNRACNGHYVNLVRAVKWWRQDNADKLPKYPKGYPLEHMIGHVLAEGTSSMATGLVQALERFRDTWYTYDLLNVVPTLTDHGVPEHNVLARLPVEDFKAFYKAVCEAAKAAREALDSTDAKESGQLWRNLLGSKFPLPGPQGGDRSSGGFTAPTQPAKPEKTERFA

SEQ ID NO: 4052 - protein, 384 aa, Unknown
  Description of Unknown: Sphingomonadaceae sequence
MELKPQFKEFLGAIRPTDAQKENWRSSSTTLRNRLSQDDDLKGLVVSTFLQGSVRRSTAVRPLGDKRPDVDIVVVTNIDSTTESARDAMDRFIPFLEKWYPGKWRPQGRSFGIEMSLVDMDLVITALPTDQNSRDFMTRLYRSQAVETLDTLEEARSWRLNEDWRPFVPSPFGDSRQIIELADAPREKWQPNPLWLPDRDADGWGRTHPLAQIQWTAAKNRANDGNYVDIVRAIKWWRQTNSDSLPKYPKGYPLEHMIGHVLQDGTTSMAQGVVQVFESMRDNWALLAAASMKPRLSDHGVPEHDVLKRLDVDDFKAFHAAAASAAETAREALLSQDAQESAGLWRDLFGSRFPVPGPQGGDRARSGFTAPAQAAVPSTTGRFA

SEQ ID NO: 4053 - protein, 384 aa, Sphingobium chungbukense
MELKPQFKEFLGAIRPTDAQKENWRSSSTTLRNRLSQDDDLKGLVVSTFLQGSVRRSTAVRPLGDKRPDVDIVVVTNIDSTTESARDAMDRFIPFLKKWYPGKWRPQGRSFGIEMSLVDMDLVITALPSDQNSRDFMTRLYRSQAVETLDTLEEARSWRLNEDWRPFVPSPFGDSRQIVELADAPREKWQPNPLWLPDRDADGWGRTHPLAQIQWTAAKNRANDGNYVDIVRAIKWWRQTNSNSLPKYPKGYPLEHMIGHVLQDGTTSMAQGVVQVFESMRDTWALLAAAGMKPRLADHGVPEHDVLKRLAVDDFKAFHAAAESAAETAREALLSQDAQESAGLWRELFGSRFPVPGPQGGDRARSGFTAPAQAAVPSTTGRFA

SEQ ID NO: 4054 - protein, 384 aa, Novosphingobium panipatense
MELKPQFKEFLGAIRPTDEQKENWRSSSTTLRNRLSQDDDLKGLVVSTFLQGSVRRSTAVRPLGDKRPDVDIVVVTNIDSTTESARDAMDRFIPFLKKWYPGKWRPQGRSFGIEMSLVDMDLVITALPSDQNSRDFMTRLYRSQAVETLDTLEEARSWRLNEDWRPFVPSPFGDSRQIVELADAPREKWQPNPLWLPDRDADGWGRTHPLAQIQWTAAKNRANDGNYVDIVRAIKWWRQTNSNSLPKYPKGYPLEHMIGHVLQDGTTSMAQGVVQVFESMRDTWALLAAAGMKPRLADHGVPEHDVLKRLAVDDFKAFHAAAESAAETAREALLSQDAQESAGLWRELFGSRFPVPGPQGGDRARSGFTAPAQAAVPSTTGRFA

SEQ ID NO: 4055 - protein, 381 aa, Ochrobactrum anthropi
MELKPQFREFLTSIRPTDRQKEDWRTGSNTLRSRLASDADLAPQIVATFLQGSVRRSTAIRPHGDKRPDVDVVVVTNINPSETSPGQAMNRFIPFLKKFYADKWKPQGRSFGIELSHVDIDLVITALPPDPQSRSTMEDLYRSQAVNTLDTLDEQPEWRLNQRWIPRDPYSLNPSFSDSQIEDAPASEWRPNPLLLPDRDIGSWGRTHPLAQIQWTAAKNRACSGLYVDIVRAIKWWRQTNIDSLPKYPKGYPLEHMIGHNLADGVTSVASGVVQVFEQIVEHWQPFAASGSVPVLSDHGVPEHDVLKRLSADDFRAFHGAVRNAAAIARDALESDGPQECANLWRRLFGNRFPLPGPNGGDRTGFTRPSRSAEPKDARFA

SEQ ID NO: 4056 - protein, 381 aa, Mesorhizobium sp.
  MOD_RES (139)..(139): Any amino acid
  MOD_RES (374)..(374): Any amino acid
MELKPQFREFLTSIRPTDKQKEDWRVGSSTLRNRLAEDDELGPQIVATFLQGSVRRSTAIRPHGDKRPDVDVVVVTTIDPTSTTPAKAMNRFIPFLDKFYNDKWRPQGRSFGIELSYVDIDLVVTALPPDQQSRKVMEXLYRSQSVNSLATLEEQPDWRLNRNWVPSNPNPLSIQKAQPLVEDAPASEWKPNPLLLPDRDVGSWGRTHPLAQIQWTASKNRACNGHYVDIVRSLKWWRQTNSDSLPKYPKGYPLEHMIGYSLQDNIASVGAGVVQVLEQMTAQWALAAELATVPNLSDHGVPEHNVLKRLSVEDFQAFHKAAGNAAAIARDALDSDDAQESGKLWQRLFGSRFPLPGPNGGDRVGFSQPSRPAXPKDARFA

SEQ ID NO: 4057 - protein, 381 aa, Neorhizobium galegae
MRLDPQFRDFLSSIRPTDKQKEDWKTGSNTLRNRLADDDKLGPEVVATFLQGSVRRSTAIRPHGDKRPDVDIVVVTNIDWTKTAPEQAMGRFKPFLNKFYKDKWRPQGRSFGIELSHVDMDLVITSLPTDQKSRGIMENLYRSQSINTLYDLEEQPNWRLNRQWTPQDFNSLITKSAPVQFNDEPEGEWKPNPLFLPDRDVGRWGRTHPIAQIQWTAEKNRACNKHYINIVRALKWWRQTNADDLPKYPKGYPLEHMIGHTLQNGTSSVAYGIVQVFEGMAEQWQTAAQFGPVPRLSDHGVPEHDVLKRLTIEDFKAFHKAAANAAQIARDAFDCEDATESGMLWQRLFGTRFPLPGPSGGDRVGFSNPTRPAEPKDARFA

SEQ ID NO: 4058 - protein, 381 aa, Xylophilus sp.
MELNQQFKTFLTEIRPTQSQKEGWIVGATTLRTRLNADPDLTKITVSTFLQGSIRRSTAIRPIGDKRPDVDVVVVTTIDYNTTTPEQAMDKFVPFLERHYAGKWRRQGRSFGIELSYVDIDLVITALPSEVTSDQAVTALYKSESVQNIQTLEEQPTWRLNKSWTAAKGDGLYPVMAIAQDAPEQDWKPHPLMLPDRDAGRWGRTHPLAQIQWTAAKNRDCNGHYVNLVKALKCWRQTNARMLPKYPKGYPLEHMIGQALANGTGSMGTGVVQVLEEMRDRWTPEVAMGRVPVLDDHGVPEHNVLQRLSFEDFEAFHKAISDAAAQARKALDAGDPSESGMLWQGLFGAKFPLPSPQGGDRPPGFTKPSGPADPQLTPRFA

SEQ ID NO: 4059 - protein, 377 aa, Sphingobium indicum
MELRPQFDQFLRDIRPSERHKEEWKMGSRTLRTRLMADPDLSPLIVSSFLQGSVRRSTAVRPTGGKRSDVDVVIVTTIDHNAEQPAVAMKRFVPFLNEHYAGKWVQQDRSFGIELSYVDLDLVVTALPANASDRDKLLAVYRSQAVETTASLEERSDWNLSKSWNPDGAVTAFMANDAMPEADWKPHPLMLPDRMVKDWGPTHPLAQIKWTADKNRACNGHYINVVRAMKWWRQEHVDSLPKYPKGYPLEHMIGYVLPNGIESVAEGVTLAFEGIRDQFRLHAQAKMVPFLPDHGVPTHDVLKRVAVTDFVAFHAAASAAAGEARRALDSEDAAESGEIWQGLFGKCFPLPGPQGGDRARGFTSPAIAAQPKTNRFA

SEQ ID NO: 4060 - protein, 381 aa, Niveispirillum sp.
MELRPQFEQFLRDIRPSERHKEEWKMGSRTLRERLDADPVLSPLIVASFLQGSVRRSTAVRPTGGKRSDVDVVVVTKIDHNADQPAVAMERFEPFLNRHYPGKWKQQDRSFGIELSYVDLDLVVTALPTDPTARAKLEELYRSKAVETTKSLEDLTGWRLSKSWNPDTSGLAAFSSTATDDTVPDADWKPHPLMLPDRAVKKWGPTHPLAQIKWTADKNRACNGHYINVVRALKWWRHEHADKLPKYPKGYPLEHMIGHVFPDDTRCLAQGVTLAFEGLRDKFGLSAQLGIVPYLADHGVPTHNVLKRLEPKDFTAFINAATAAADTARKALDSQDAEESGGFWQELFGTSFSLPGPQGGDRARGFTAPTVAAQPKTDRFA

SEQ ID NO: 4061 - protein, 378 aa, Sphingomonas sp.
MELRPQFDAFLRDIRPSERNREEWKRGSNTLRARLLADPDLSPIITNSFLQGSVRRSTAVRPTGGKRSDVDVVIVTTIDHNVETPQVAMKRFEPFLERHYAGKWVQQDRSFGIEMSYVDLDLVITALPAEPEARAALATLYRSQAVTTDESIEEASDWVVNKSWDPSRHFETATMLTEDTATGWRDDPLMLPDRPIRDWGPTHPLAQIQWAADKNRRCNGDFVNVVRALKWWRHEHADELPKYPKGYPLEHMIGHVLPDGITSVAEGVLKAFEGIRDTFRFNAAAGVVPRLPDHGVPSHDVLKRLDAKDFVAFYNEATKAADVARRAFDELDKDSSGALWQELLGKCFPLPGPGGGDRGRGFTTPAAAATPRQSDRFA

SEQ ID NO: 4062 - protein, 377 aa, Pseudomonas aeruginosa
MELRPQFTEFLQNIRPSERNKEEWKRGSNTLRARLMADPDLSPLITTSFLQGSVRRSTAIRPTGGKRSDVDVVIVTNIDHNVEKPAAAMKRFEPFLNQHYQGKWTQQDRSFGIEMSYVDLDLVVTALPTEPSAREALQNLYSSQSVQTDQSIEERNDWVLNKSWDPSQLNGGLVMLTEDSSNWRDAPLMLPDRPIQDWGPTHPLAQIQWAADKNRRCNGHFVNVVRSIKWWRHEHAAVLPKYPKGYPLEHMIGHVLPDGINCVAEGVVKALEGIRDTWAAYAQAGLVPTLPDHGVPSHDVLGRLNADDFGAFHAEATKAANLARRAYDEADKDASGLLWQKLFGKCFPLPGPGGGDRGRGFSAPTAAATPRQSERFA

SEQ ID NO: 4063 - protein, 377 aa, Bordetella bronchiseptica
MELRPQFEEFLRDIRPSERNKEEWKRGSNTLRARLMADPDLSPLITTTFLQGSVRRSTAVRPTGGKRSDVDVVIVTTIDHPVEKPAVAMKRFEPFLNRHYAGKWTQQDRSFGIEMSYVDLDLVVTALPTEPKARAILESFYRSQAVETDQSIEDRSDWVLNKSWNPSLTNSSLISLPDDSADWKNDPLMLPDRPIQEWGPTHPLAQIEWAAAKNRRCNGHYVNVVRSIKWWRHEHGADLPKYPKGYPLEHMVGYVLPDGITCVAEGVVKALEGIRDKFAAHAAAGIVPVLPDHGVPSHDVLKRLIAEDFAIFHARVGTAAGLARRAFDEVDKDISGSLWQELLGSCFPLPGPGGGDRGRGFSAPAVAAKPKQSERFA

SEQ ID NO: 4064 - protein, 377 aa, Stenotrophomonas maltophilia
MELRPQFAEFLQDIRPSERNREEWKRGSNTLRTRLMADAELSPMIAATFLQGSVRRSTAVRPTGGKRSDVDVVIVTTIDYNRETPRVAMKRFEPFLERHYQGKWAQQDRSFGIEMSYVDLDLVVTALPAEPATRAALESLYRSQAVQLDESLEERSDWVLNKGWDPQRANGGLVSLTEEASTWRDEPLMLPDRPVQKWGPTHPLAQIQWAAAKNRNCNGHFINVVRSIKWWRHEHADTLPKYPKGYPLEHMIGAVLPDHIQSVAEGVTLALEGIRDTWAAYAAAGVVPFLADHGVPSHNVLQRLGAEDFRAFMAKAGEAADLARRALNETDKDVSGALWRELLGNSFPPPGPGGGDRGRGFAAPAAPAVPRQSGRFA

SEQ ID NO: 4065 - protein, 377 aa, Stenotrophomonas maltophilia
MELRPQFAEFLQDIRPSERNREEWKRGSNTLRTRLMADAELSPMIAATFLQGSVRRSTAVRPTGGKRSDVDVVIVTTIDYNRETPRVAMKRFEPFLERHYQGKWAQQDRSFGIEMSYVDLDLVVTALPAEPATRAALESLYRSQAVQLDESLEERSDWVLNKGWDPQRANGGLVSLTEEASTWRDEPLMLPDRPVQKWGPTHPLAQIQWAAAKNRNCNGHFINVVRSIKWWRHEHADTLPKYPKGYPLEHMIGAVLPDHIQSVAEGVTLALEGIRDTWAAYAAAGVVPFLADHGVPSHNVLQRLGAEDFRAFMAKAGEAADLARRALNETDKDVSGALWRELLGNSFPLPGPGGGDRGRGFAAPAAPAVPRQSGRFA

SEQ ID NO: 4066 - protein, 403 aa, Rhodobacter sphaeroides
MKLESQFRDFLREIRPTETQQEDWKAGAKTLRTRLAQDPDLKDILEETFLQGSIRRSTAIRPSGNKRPDVDIVVVTNIDYTQTTPQQAMDLFKPFLDKHYGGKWRPQGRSFGIELSYVDMDLVITALPRTVQLLDERQVARFADKDALTSIYKSDAATSLSTLEEDTSWRLNTRWQDSRSFSDLDGLNRELGSAVNESLKDEVTEEWKSEPLWLPDRDTKKWGRTHPLLQISWTAEKNRRTNKTYLHIVRAIKWWRLEIAEKLPKYPKGYPLEHMVGHLLEDGADLSTAQGIVQVFESFRDKWLLVARNHQVPVLCDHGVAEHNVLARLSAEDFVGFVEVVSKFAALARQAFNSTDPVESGKLWQQIFGSKFPLPGPNGGDRTGSHFVKPTVAAVPPTSDRFA

SEQ ID NO: 4067 - protein, 403 aa, Rhodobacter megalophilus
MKLESQFRDFLREIRPTETQQEDWKAGAKTLRTRLAQDPGLKDILEETFLQGSIRRSTAIRPTGDKRPDVDIVVVTNIDYTQTTPQQAMDRFKPFLDKHYGGKWRPQGRSFGIELSYVDMDLVITALPRTVQLLNERQVASFADKDALTSIYKSAAATSLSTLEEDTSWRLNTRWQDSRSFSDLDGLNRELGSAVNESLKDEVTEEWKSEPLWLPDRDTKKWGRTHPLLQISWTAEKNRKTNKTYLHIVRAIKWWRLEIAEKLPKYPKGYPLEHMVGHLLVDGADLSTAQGIVQVFESFRDKWLLVAKNHQVPVLCDHGVAEHNVLARLSPEDFEGFVEVVSEFAALARQAFNSTDPAESGRLWQQIFGSRFPLPGPSGGDRPVGHFVKPTVAAVPPTSDRFA

SEQ ID NO: 4068 - protein, 404 aa, Albimonas donghaensis
MKLDVQFKEFLSQIRPTDPQQEAWRAAAKTLRDRLAADSDLKNIVVSTFLQGSIRRATAIRPLGEKRPDVDIVVVTNIDHEKVRPEDAMNLFVAFLDKYYKEKWRPQGRSFGITMSAVDMDLVITALPRPSGTPHGITEDASLTAASDIAAIYRSDAARSLDTLEDDMSWRLNVGWRQRNVFDELGRPAPMLTESVTQVLDDAPPQGWKDNPLWLPDRDTKTWGRTHPLLQISWTAEKNRRTNRTYLNVVRVIKWWRLEKAEKLPKYPKGYPLEHMVGYLLEDGSDLTTAEGVVQVFEAFRDQWLSRARARDVPALADHGVAEHNVLARLSPEDFEAFVEIVNGFAALAREALEAEDAAVSGALWRRMLGDRFPLPPPRGGDRVPAQFAAPPAVTSVARSDRFA

SEQ ID NO: 4069 - protein, 381 aa, Klebsiella pneumoniae
MELQPQFNEFLANIRPTDTQKEDWKSGARTLRERLKNFEPLKEIVVSTFLQGSIRRSTAIRPLGDKRPDVDIVVVTNLDHTRMSPTDAMDLFIPFLEKYYPGKWETQGRSFGITLSYVELDLVITAIPESGAEKSHLEQLYKSESVLTVNSLEEQTDWRLNKSWIPNTGWLSESNSAQVEDAPASEWKAHPLVLPDREKSEWGRTHPLAQIRWTAEKNRLCNGHYINLVRAVKWWRQQNSEDLPKYPKGYPLEHLIGNALDNGTTSMAQGLIQLMDTFLLRWAAIYNQKSKPWLSDHGVAEHDVMARLTAEDFCSFYEGIAGAAEIARNALASEDPQESAQLWRQLFGSKFPLPGPQGGDRNGGFTTPSKPAEPQKTGRFA

SEQ ID NO: 4070 - protein, 381 aa, Unknown; identical to SEQ ID NO: 4069
  Description of Unknown: Enterobacteriaceae sequence

SEQ ID NO: 4071 - protein, 381 aa, Klebsiella pneumoniae
MELQPQFNEFLANIRPTDTQKEDWKSGARTLRERLKNFEPLKEIVVSTFLQGSIRRSTAIRPLGDKRPDVDIVVVTNLDHTRMSPTDAMDLFIPFLEKYYPGKWETQGRSFGITLSYVELDLVITAIPESGAEKSHLEQLYKSESVLTVNSLEEQTDWRLNKSWIPNTGWLSESNSAQVEDAPASEWKAHPLALPDREKSEWGRTHPLAQIRWTAEKNRLCNGHYINLVRAVKWWRQQNSEDLPKYPKGYPLEHLIGNALDNGTTSMAQGLIQLMDTFLLRWAAIYNQKSKPWLSDHGVAEHDVMARLTAEDFCSFYEGIAGAAEIARNALASEDPQESAQLWRQLFGSKFPLPGPQGGDRNGGFTTPSKPAEPQKTGRFA

SEQ ID NO: 4072 - protein, 381 aa, Klebsiella aerogenes
MELQPQFNEFLANIRPTDTQKEDWKSGARTLRERLKNFEPLKEIVVSTFLQGSIRRSTAIRPLGDKRPDVDIVVVTNLDHTRMSPTDAMDLFIPFLEKYYPGKWETQGRSFGITLSYVELDLVITAIPESGAEKSHLEQLYKSESVLTVNSLEEQTDWRLNKSWTPNTGWLSESNSAQVEDAPASEWKAHPLVLPDREKNEWGRTHPLAQIRWTAEKNRLCNGHYINLVRAVKWWRQQNSEDLPKYPKGYPLEHLIGNALDNGTTSMAQGLVQLMDTFLSRWAAIYNQKSKPWLSDHGVAEHDVMARLTAEDFCSFYEGIAGAAEIARNALASEEPQESAQLWRQLFGSKFPLPGPQGGDRNGGFTTPSKPAEPQKTGRFA

SEQ ID NO: 4073 - protein, 381 aa, Trabulsiella odontotermitis
MELQPQFNEFLANIRPTDTQKEDWKSGARTLRERLKNFGPLKEIVVSTFLQGSIRRSTAIRPLGDKRPDVDIVVVTNLDHTRMSPTDAMDLFIPFLEKYYPGKWETQGRSFGITLSYVELDLVITAIPESGAEKSHLEQLYKSESVLTVNSLEEQTDWRLNKSWTPNTGWLSESNSAQVEDAPASEWKAHPLVLPDREKNEWGRTHPLAQIRWTAEKNRLCNGHYINLVRAVKWWRQQNSEDLPKYPKGYPLEHLIGNALDNGTTSMAQGLVQLMDTFLSRWAAIYNQKSKPWLSDHGVAEHDVMARLTAEDFCSFYEGIAGAAEIARNALASEEPQESAQLWRQLFGSKFPLPGPQGGDRNGGFTTPSKPAEPQKTGRFA

SEQ ID NO: 4074 - protein, 381 aa, Erwinia typographi
MELQPQFNEFLANIRPTDTQKEDWKSGARTLRERLKNFEPLKEIVVSTFLQGSIRRSTAIRPLGDKRPDVDIVVVTNIDHTRMSPTDAMDLFIPFLEKYYPGKWETQGRSFGITLSYVELDLVITAIPESGAEKSHLEQLYKSESVLTVNSLEEQTDWRLNKSWTPNTGWLSESNSAQVEDAPASEWKAHPLVLPDREKNEWGRTHPLAQIRWTAEKNRLCNGHYINLVRAVKWWRQQNSEDLPKYPKGYPLEHLIGNALDNGTTSMAQGFVQLMDTFLSRWAAIYNQKSKPWLSDHGVAEHDVMARLTAENFCSFYEGIAGAAEIARNALASEDPQESAQFWRQLFGSKFPLPGPQGGDRNGGFTTPSKPAEPQKTGRFA

SEQ ID NO: 4075 - protein, 381 aa, Serratia marcescens
MELQPQFNEFLANIRPTDTQKEDWKSGARTLRERLKNFEPLKEIVISTFLQGSIRRSTAIRPLGDKRPDVDIVVVTNLDHTRMSPTNAMGLFIPFLEKYYPGKWETQGRSFGISLSYVELDLVITAIPESGAEKSHLEQLYKSESVLTVNSLEEQTDWRLNKSWTPNMGWLSESNSAQIEDAPASEWKAHPLVLPDREKNEWGRTHPLAQIRWTAEKNRLCNGHYINLVRAVKWWRQQNSENLPKYPKGYPLEHLIGNALDNGTTSMAQGLVQLMDTFLSCWAAIYNQKSKPWLSDHGVAEHDVMARLTAEDFCSFYEGIAGAAEIARNALASEDPQESAQLWRQLFGSKFPLPGSQGGDRNGGFTTPSKPAEPQKTGRFA

SEQ ID NO: 4076 - protein, 381 aa, Unknown
  Description of Unknown: Enterobacter cloacae complex 'Hoffmann cluster IV' sequence
MELQPQFNEFLANIRPTDTQKEDWKSGARTLRERLKNFEPLKEIVVSTFLQGSIRRSTAIRPLGDKRPDVDIVVVTNLDHTLMSPTDAMDLFIPFLDKYYPGKWETQGRSFGITLSYVELDLVITAIPESGAEKNHLEQLYKSESVLTVNSLEEQTDWRLNKSWSPNTGWLSESSSAQVEDAPASEWKAHPLVLPDREKNEWGRTHPLAQIRWTAEKNRVCNGHYINLVRAVKWWRQQNSENLPKYPKGYPLEHLIGNALNNGTTSMGKGLVQLLDTFLCRWADIYSQKGKPCLPDHGVEEHDVMARLSTDDFCSFYEGIAGAAEIARNALASQDPQESAELWRKLFGAKFPLPGPQGGDRNGGFTVPIKPAEPQKTGRFA

SEQ ID NO: 4077 - protein, 381 aa, Enterobacter hormaechei
MELQPQFNEFLANIRPTDTQKEDWKSGARTLRERLKNFEPLKEIVVSTFLQGSIRRSTAIRPLGDKRPDVDIVVVTNLDHTLMSPTDAMDLFIPFLDKYYPGKWETQGRSFGITLSYVELDLVITAIPESGAEKKHLEQLYKSESVLTVNSLEEQTDWRLNKSWSPNTGWLSESSSAQVEDAPASEWKAHPLVLPDREKNEWGRTHPLAQIRWTAEKNRVCNGHYINLVRAVKWWRQQNSENLPKYPKGYPLEHLIGNALNNGTTSMGKGLVQLLDTFLCRWADIYSQKGKPCLPDHGVEEHDVMARLSTDDFCSFYEGIAGAAEIARNALASQDPQESAELWRKLFGAKFPLPGPQGGDRNGGFTVPSKPAEPQKTGRFA

SEQ ID NO: 4078 - protein, 381 aa, Unknown
  Description of Unknown: Enterobacter sequence
MELQPQFNEFLANIRPTDTQKEDWKSGARTLRERLKNFEPLKEIVVSTFLQGSIRRSTAIRPLGDKRPDVDIVVVTNLDHTLMSPTDAMDLFIPFLDKYYPGKWETQGRSFGITLSYVELDLVITAIPESGAEKNHLEQLYKSESVLTVNSLEEQTDWRLNKSWSPNTGWLSESSSAQVEDAPASEWKAHPLVLPDREKNEWGRTHPLAQIRWTAEKNRVCNGHYINLVRAVKWWRQQNSENLPKYPKGYPLEHLIGNALNNGTTSMGKGLVQLLDTFLCRWADIYSQKGKPCLPDHGVEEHDVMARLSTDDFCSFYEGIAGAAEIARNALASQDPQESAELWRKLFGAKFPLPGPQGGDRNGGFTVPSKPAEPQKTGRFA

SEQ ID NO: 4079 - protein, 381 aa, Leclercia adecarboxylata
MELQPQFNEFLANIRPTDTQKEDWKSGARTLRERLKNFEPFKEIVVSTFLQGSIRRSTAIRPLGDKRPDVDIVVVTNLDHTLMSPTDAMDLFIPFLDKYYPGKWETQGRSFGITLSYVELDLVITAIPESGAEKNQLEQLYKSESVLTVNSLEEQTDWRLNKSWSPNTGWLSESNSAQVEDAPASEWKAHPLVLPDREKNEWGRTHPLAQIRWTAEKNRVCNGHYINLVRAVKWWRQQNSENLPKYPKGYPLEHLIGNALNNGTTSMGKGLVQLLDTFLCRWADIYSQKGKPCLPDHGVEEHDVMARLSTDDFCSFYKGIAGAAEIARNALASQDPQESAELWRQLFGSKFPLPGPQGGDRNGGFTVPSKPAEPQKTGRFA

SEQ ID NO: 4080 - protein, 381 aa, Unknown
  Description of Unknown: Enterobacter cloacae complex sequence
MELQPQFNEFLANIRPTDTQKEDWKSGARTLRERLKNFEPLKGIVVSTFLQGSIRRSTAIRPLGDKRPDVDIVVVTNLDHTRMSPTDAMDLFIPFLDKYYPGKWETQGRSFGITLSYVELDLVITAIPESGAEKSHLEQLYKSESVLTVNSLEEQTDWRLNKSWSPNTGWLSESNSAQVEDAPASEWKAHPLVLPDREKNEWGRTHPLAQIRWTAEKNRVCNGHYINLVRAVKWWRQQNSENLPKYPKGYPLEHLIGNALDNGTTSMGKGLVQMLDTFLCRWADIYSQKGKPCLPDHGVDEHDVMARLSTDDFCSFYEGIAGAAEIARNALASQDPQESAELWRQLFGAKFPLPGPNGGDRNGGFTVPSKPAEPQKTGRFA

SEQ ID NO: 4081 - protein, 381 aa, Buttiauxella brennerae
MELQPQFNEFLANIRPTDTQKEDWKSGARTLRERLKNFEPLKEIVVSTFLQGSIRRSTAIRPLGDKRPDVDIVVVTNLDHTRMSPTDAMDLFIPFLDKYYPGKWKTQGRSFGITLSYVELDLVITAIPESGAEKSHLEQLYKSESVLTVNSLEEQTDWRLNKNWSPNTGWLSESNSAQVEDAPASEWKAHPLVLPDREKNEWGRTHPLAQIRWTAEKNRVCNGHYINLVRAVKWWRQQNSENLPKYPKGYPLEHLIGNALDNGTSSMGKGLVQLLDTFLCRWADIYSQKGKPCLPDHGVEEHDVMARLSTEDFCSFYEGIAGAAEIARNALASQDPQESAELWRQLFGSKFPLPGPQGGDRNGGFTVPSKPAEPQKTGRFA

SEQ ID NO: 4082 - protein, 381 aa, Pantoea septica
MELNSQFNEFLTHIRPTATQKEDWKSGAKTLRDRLKNYEPLQDIVVSTFLQGSIRRSTAIRPLGDKRPDVDIVVVTNLDHMKTAPKEAMDLFVPFLEKHYPGKWVTQGRSFGITLAYVELDLVITAIPASGEEKNRLEQLYRSESVLTVNSLEEQSDWRLNKSWSPVTSSWFQNNSSPVQDAPASEWKAHPLVLPDREKNEWGRTHPLAQIRWTAEKNRLCNGHYINIVRAVKWWRQQNSENLPKYPKGYPLEHLIGNALDDGTNSMARGLVQLMDTFLVRWKDIYNHKSKPWLSDHGVEEHDVLARLSAGDFCDFYEGLEVAAEIARSALASEDAKESAELWRKLFGSKFPLPGPQGGDRNGGFTPPSKPADPQKTGRFA

SEQ ID NO: 4083 - protein, 381 aa, Pantoea brenneri
MELNTQFNEFLANIRPTATQKEDWKGGAKTLRDRLKNYEPLQDIVVSTFLQGSIRRSTAIRPLGDKRPDVDIVVVTNLDHTKIAPSEAMDLFVPFLEKYYPGKWVAQGRSFGITLTYVELDLVVTAIPASGEEKIRLEQLYRSESVLTVNSLEEQTDWRLNKSWSPVTSSWSQNNSSPVQDAPASEWKAHPLVLPDREKNEWGRTHPLAQIRWTAEKNRLCNSHYINIVRAVKWWRQQNSENLPKYPKGYPLEHLIGNALDDGTTSMARGLVQLMDTFLVRWKDLYTIKSKPWLSDHGVEEHDVLARLSAGDFCDFYEGLEVAAEIARSALASEDAKESAELWRKLLGSKFPLPGPQGGDRNAGFTPPSKAADPQRTGRFA

SEQ ID NO: 4084 - protein, 381 aa, Klebsiella oxytoca
MELNPQFNEFLTNIRPTETQKEDWKGGAKTLRERLNNYEPLKDIVVSTFLQGSIRRSTAIRPLNGKRPDVDIVVVTNLDHTQIAPRDAMDLFVPFLDKYYSGKWVPQGRSFGITLSYVELDLVITAIPASGQEKSLLEQLYRSESVLTVDSLEEQQDWRLNKSWIPNAGGLFMTNSANVQDAPASEWKSHPLALPDRDENLWGRTHPLAQIRWTAEKNRACNGHYINLVRAVKWWRQHNSDNLPKYPKGYPLEHLIGNVLDDDTPSMGKGLVQLIDSFLSRWAFVYNLGSKPSLPDHGVEEHDVLARLSAEDFCLFYEGLADAAVIARNALESQDPKESAELWRQLFGTKFPLPGPKGGDRSGGFTTPTQPAVPQKTGRFA

SEQ ID NO: 4085 - protein, 381 aa, Salmonella enterica
MELNSQFNAFLTNIRPTDPQKEDWKGGAKTLRERLNNYEPLKDIVVSTFLQGSIRRSTAIRPLNGKRPDVDIVVVTNLDHNQIAPQEAMDLFVPFLEKYYPEKWVPQGRSFGITLSYVELDLVITAIPASGEEKNLLEQLYRSESVLTVNSLEEQKDWRLNKSWKPSESGLFISNSANIQDAPLSEWKAHPLVLPDRDENKWGRTHPLAQIRWTAEKNRACNGHYINLVRAVKWWRQQNSDNLPKYPKGYPLEHLIGNALDDGTPSMGKGLVQLIDTFLSRWAYVYSLRSKPSLPDHGVEEHDVLARLSAEDFCLFYEGLEDAAIIARSALASQDPKESAELWRKLFGTKFPFPGPQGGDRSSGFTAPTQPAEPQKTGRFA

SEQ ID NO: 4086 - protein, 381 aa, Escherichia coli
MELNPQFNEFLTKIRPSDTQKEDWKSGAKTLRERLNNYEPLKGIVVSTFLQGSIRRSTAIKPLNGKRPDVDIVVVTNLDHTRTAPMEAMDLFVPFLEKYYPGKWEPQGRSFGITLSYVELDLVITTIPASGEEKKEILQLYCSESVLTVNSLEEQNDWRLNKSWKPNGGSLFESNAVSFQDAPASEWKAHPLLLPDRDENKWGRTHPLAQIRWTAEKNRACNGHYINLVRAVKWWRQQNVDNLPKYPKGYPLEHLIGNALNDGTPSMAKGLVQLIDTFLIRWKSFYNERSKPSLSDHGVEEHDVLARLSAEDFCLFYEGLAEAAIIARKALASTDPKESGELWQKLFGTRFPLPGPQGGDRSGGFTTPTKPAEPQKTGRFA

SEQ ID NO: 4087 - protein, 218 aa, Nannocystis exedens
MELNYRFRRFLEQIRPSQGQLREFRRAHLELSRRLRADPELGRYHVATFLQGSYRRSTALRPLAGGEGSDVDLVFVTNLDPVRYGPEKALRLLRPFLQRHYANVRAQGRSFRIQCDEVDLDLVLASAPSRVDLQQMLAEARAEPLEEGFEPTEAELSAWKTEPLLIPDREADRWRQSHPLAQLASTRSKNARCNQHFLGVVKALKCWKCTASAGPQRA

SEQ ID NO: 4088 - protein, 362 aa, Lactococcus lactis
MAEAKQYFKDFLSNIRLSKYQMEDLARGHNTLRDRLKSDDELSKIVQTTFLQGSYKRSTAVKPKNGKRSDVDIIVVTNIDAEKVTPQEAMNLFVPFLNKHYKDKWEFNSRSIGIKLSYVDLDLVVTAEIKDDEALNFMQREEGITTGSISKALENNLISVDYFNIFDSIFLNANKKANPDVLLIPDRETKTWEETNPLAQINWTIDKNSACNKHYVNVVKALKWWKKLNTSPKYPKGYPLEHLIGVTCPDGIESVAEGVVSVLENIVNDYSQKPILKDHGVPDHDVFERISDEDYNEFYKLVEKAAKQARKALNEEEFSTSIEYWRELFGNEFPEPQNLSNQKSNFSERSAATKNIGSARFG

SEQ ID NO: 4089 - protein, 361 aa, Listeria monocytogenes
MAIVNSYFTDFLRNIRLTQNQIKDLARGHNTLRNRILDDDDLSEIIETTFLQGSYKRNTAVKPKGGKRSDVDIIVVTNIDASTLTPDEALAKFKPFLDKYYPNKYTINQRSIGIELSYVDLDLVITAKVKDAETLSLMKNEGRNMTKGLQTMISTEKYDTSVLDDLVIKMDSKDKEEPEPILIPDTNKNEWSLTNPLAQIYWTLEKNKKCNGNYINVVKALKWWKKYHDMPKYPKGYPLEHIIGQTCPDDIDTVAQGITETLEGIVRKYPTKPILIDHGVNDHDVFGRITEDEYKEFYDLIKNAASMARKAIDESDLSTSIVYWRDLLGTEFPSPPSPPSTNNKFTPRNSPTEEIGSARFG

SEQ ID NO: 4090 - protein, 361 aa, Enterococcus sp.
MATVNSYFSDFLKNIRLTQNQIKDLARGHNTLRSRLLADDDLSEIIETTFLQGSYKRNTAVKPKGENRSDVDIIVVTNIDADQVTPDEALERFKPFLEKYYADKYTINQRSIGIELSYVDLDLVITAKVQDAETLNLMKNEGRKMTRGLQTMISNEEYYDSALGELVIKMDTETKNAAPILIPDTSENTWSLTNPLAQIHWTVEKNKTCNGNYINVVKALKWWKKHHEIPKYPKGYPLEHIIGQSCPDNIDTVAQGVTVTLEEIVRKYPTKPVLIDHGVEEHDVFGRITEEEYEEFYNLIKEAAFTARKAIDETEFSTSANYWRNLLGTEFPEPKTPPTDSNNKFTSRNSPTEDIGSARFG

SEQ ID NO: 4091 - protein, 368 aa, Ignavibacteria bacterium
MELKKAFEEFLKNIRLTQSQKDDLARGHSTLRERLAAFTEFPDDIKILNTFLQGSYRRGTAVKPNGDKRADVDVVVVTNIDEHTTTPDKALASFKPFLEKYYAGKYSLNSRSYGIELSYVDLDLVITTKPSQINEMLFKADSFIFSDFTLESARNNYEFSNSISNVYDWKPEPLLIPDKDAKKWIETNPLAQIQWAQRKNACCNFHYINVVKSLKWWQINNNQSGYLPKYPKGYPLEHIIGYCCPDGIDSVAKGINETFRNIIEKFEEDIRWNRVPKLLDHGVKDHNVLKRVEFDDFKLFYEKVEDDYNNLSNIAYYSADSEKSAAYWNQLLGKEFPSETDIFKFIEEEEGPFKNISIIGNTRPEEYA

SEQ ID NO: 4092 - protein, 337 aa, Bdellovibrio sp.
MHELPSYFKEFLSNINPSSSYLEDQRTGHLTLRKRFREDSDFGQYHINTFLQGSYARDTAIHPGKDVDVVVVTNLDSDKTTVADVYEYMPKILDRYYEGKWKPQGRSFGISLSYVDLDVVISTSRHLGDQELVTLSKSLVLNEADIDWRDHPLLIPDRDRGQWVETNPKAQLQATTDLNKQAKGYFVHLVKIFKWWRKEAYTTPERPKGYILERIVAENINVNCDSYPQHIQTLFTNIIKNYHTHALYGTVPFLPDPGNPKHNVAARVDPNDFKIFYNKVVATFPTINLACSETNAARATEYWRQVFGSKFPVSVTKSNDASFPARPVVPNKPAGFA

SEQ ID NO: 4093 - protein, 290 aa, Bradyrhizobium sp.
MELSADFARCISSCEPDDDAVKTAKKAHEKVRDELKTDEETKDAHEETFLTGSYRRHTAIHNIEDVDVVCILDLDIYADGSEPEVVLTWLQGVLDKYYSETRPQGRSIGISAKGVWLDIVPGTPVYEDGPLWIPDRDAKQWVQSHPKGQISAASEKNKDTGGYYVQTVKLIKSWRDRLPTEKSKPKSYILETLVHQTIGLPTSHARAVVNVLEGINSTYGFYRGLGTVPFIADPGLGTVNVAKRWDSAEFDAFLDQVKAAATTARQALEATDEAESRKLWRKLFGSTFGA

SEQ ID NO: 4094 - protein, 290 aa, Bradyrhizobium sp.; identical to SEQ ID NO: 4093

SEQ ID NO: 4095 - protein, 290 aa, Afipia broomeae
MELSGDFAKYVSSCEPDDDAVATAKKAHEKVRDELKTDEDTKDAHEETFLTGSYRRHTAIHNIEDVDVVCILDLDIYAEGSEPEVVLTWLQATLDKYYSETRSQGRSIGVSAKGVWLDIVPATPVYKDGPLWIPDRDAKEWVQSHPKGQISAASDKNKLTGGYYVQTVKLMKAWRDRLPTEKSKPKSYILETLVHQTIGLSASHARGIVNVLEGINSTYGFYRGLGTVPFIADPGLGTVNVAKRWESADFDAFLDQVKSAATTARQALDSNDEAESRKLWRKLFGSTFGA

SEQ ID NO: 4096 - protein, 290 aa, Alphaproteobacteria bacterium
MEHPGDFAAYVSALEPDADAVTAAKNAHEKVRERLKNDDDTKDAHKDTFLSGSYARHTAIHDINDVDVICIVDIDHTITEPDVVLSWLKGVLSKYYKETRLQGRSIGASAAKGVWLDIVPSTPLSADDGPLWIPDRDAKEWVQSHPKGQIAAATSKNKVTDGYYVQTVKLLKAWRDRLPTEKSKPKSYILETLAHQTIGSPLSHARAVVSVLEGIQSSYGFYRGTGIVPQITDPGYFSVNVAKRWASADFDAFLDQVKPAAETARGALDATDEAESRKLWRKLFGSTFGQ

SEQ ID NO: 4097 - protein, 430 aa, Bifidobacterium biavatii
MTLDKYFTKFLTDIEPSRSTKDEIKRIHSNLREFLSEDDDCAAIVDSTFLSGSYAKNTSIRPVLNDGKRDVDIDIVTNFTMNDDPAVVLEKIEDLLHKQAKYSNTKKQSHSICVEMSGLNVDVVPLIREDDSSYYIGSRDNHTWSKATPKEHIQWSSDVNAENNMKYKPLVKLFKWWRRENCPDGVRFPKGIALEVIVADNIGNVSQSTEDLLIDTMRSIVSRYRGYVVNGFVPFLQDPAMTDNDLLSRTSFDDFQKFIGALENHLSLIDDEGRNNVVWKKIFGERFPSDNKKSLDLESYKTVSYRQVPPWSLPHKPSVTIKATVVFPNDAECEISSDDFLLPKGSSIKYMAAYPITSKDTVKWQIVNTGKEAELASCLRGGFENSNNFNSGPLCRIESTAYTGKHYVQCFIVRNGCCIAYSDEFFINVE

SEQ ID NO: 4098 - protein, 435 aa, Collinsella sp.
MTNSADFESFLKDINPSKSTIDEASRLHRNLRDHLKASETYGAICKDTYLSGSYAKQTFIRPKKDSDSCDIDVIVETNHSINDSPFCVLLELEDAIRERECYKNVRVQTHSIGIDMANFHLDVVPLVNDEDGLLYIGSKDDSEWRQTNPKEHLTWSTEVNKEFNGDYKPLVKIMKWWRRENCPSLVKFPKGITLEKMIADNLPEAGLSIEDCVMQVMANLAVAYADELDSYQVPFIEDPAIEGNNLAGKYCYNDFAQFVYKLNEHLSHLADEGTGNSVWKQILGNNFPSGGPSCGTTSSAKSKNQQYALSVQHRQPLGFPMQARKPNATITATVKLPSGEIRVLENDGAPIPKGSTIMYRVNCGPVKDGKVKWQVTNTGDEAMKVCPRGGFELPNIEKTSRREETAYTGKHYVQCFVIRRGYCVRWSNPFFINVE

SEQ ID NO: 4099 - protein, 438 aa, Unknown
  Description of Unknown: Olsenella sequence
MSLQDDFRAFLHDIEPKKSTVDEIASAHKTLRVYLEGHEYYSQRCIATYLSGSYAKHTAIRPVKDEDHRDVDIVVETDYSTSDNSADSIIELRDVLYESDKYKSVRLQTHSVGIALSKLDIDVVPLASEGERRFIGNLDDASWRETNPKGHIEWSSQTNARHDGLYVPVVKMMKWWRREHCPKMRRWPKGITLEKIIADCFPEDSSAYEELMIGLLEIIHDSLSEELETGVVPVIADPVLPTNNLAESYTLEDFRSFIGGLEEALYVLQEEGSNNDSWRKILGNRFPSGNSNASYKALAKSVYTVEQALCVPHRKSSPWPFTKRRPGVVVVVADVTFEDGHVETISSNGRVIPKGCQIDYRVIRSKGLQSLTAKWLVVNTGEEAYAAGCPRGEFENSNLAGGGRHESTAYAGRHYVQCLLIKGGRCVARSKEFFIIVQ

SEQ ID NO: 4100 - protein, 486 aa, Unknown
  Description of Unknown: Enterococcus sequence
MGNSSYFTNLLTNIELSKTTKSYVSSLQSNLRDYLKNHIEYKTKHIDTFLSGSYAKNTSIRPSLNEENQDVDIVVLTNYTRDTPPVQVLNELKSVLKNNSKYKEVKLQSKSIGIEMANYHIDVVPIVKEADHFYIGNHEKDEWNLTDPKKHISWSTEINMKNEGKYKPIVKIFKWWRKRKVVGDLKLPKGILLEKIIADNFGESKYDIENLLVMTMENIVDNYKTVYIDKKVVPSVYDPVLPKNNLFDKYTFDDFSKFIELLQQDLLFLRENHCTVEAWEKILGNSGGKSIEDVREEYSFSLKRQMDQLLNQVIEKSKQLSVEIKDYENKKKEIENREKSMQKKEDEIKYDVYLDFLQEAKYNLSDELIKGMGREYWMDMIKILESIKKKKNSSFRGYEYSYFASLYKALELKEEYYNSICLMVEDGFYLSNYDVKYIIDNTYFRKRLIDILRAKIIKGDYSDTVESYRIALKLLEENYFQKSENN

SEQ ID NO: 4101 - protein, 487 aa, Unknown
  Description of Unknown: Virgibacillus sequence
MGNYQYFYNLLSNIEPSKSTKNYVSSLQSNLREYLKNSEQYKHKHIDTFISGSFAKNIAIRPSVNEDKQDVDIVVVTNYNKKTSPEHILTELKDVLSIREKYKNIRLQSKSVGIDMANYHIDIVPLIAEDNHFWIGNRENNEWILTNPKKHIEWSTRINTDNENKYKPLVKLLKWWRKRKNIEQVRLPKGILLEKLIADNIGNSKYDMENLLITTLENIVDNFKDDYIAKKIIPTINDPILQENNLAENYSLEDFTVFIELIQQDLEQIKSADFSVDIWKKIFGKDSAKSIEETQEEYSLTAKSQIDCLLNEVVEKSQELAINIKEYEQKKQDLEKKETDISNRKKNIQSELDDLKYTLYIDFIQEASNSLSSELIKDTGREYWIKKIETLEEINKKKRRGFRGYEHNYLATIYKALELHEKFYDSICSMVKDNFYLSIYEVKDVIEKTPYRITLINSLKAAIKHDDYSSTNKSFKEALKLLEKDRK

SEQ ID NO: 4102 - protein, 321 aa, Elusimicrobia bacterium
MELEGSFRKFASNIEPAQTHRDEAISGHTTLRERLEKDSDVKVVLKETFLSGSYRRRTAVKPIKDVDIFVVLAGEQGSARKTLEWLEKALGRLGYKAKTAPQRRSVRVDLSYVTMDVVPALAPEGLDRPLKIPARQEDKWILSHPKKHIEYVENLNQLSSDERLVPTVKMIKWWRGYQMEKAKHPKSFFLENLCCRHVNMTASSYAEACVSIFESMVNSYGQVPDRVAQIADPGLSGQMISTGITLQEFQDFMGRVHQSLGAAQAALRSDNEKDSAALWRQVFGPEFPGSDDGGAKSPSIIAGPSALRRSPRDVRESPPFA

SEQ ID NO: 4103 - protein, 382 aa, Chloroflexi bacterium
MTTLNDLFIEYLASIQPYSKAVERAQLAHTCLREDLEGDENLGAHMLNSFLSGSYGRSTAIKGIKDVDVVIPFDYSFEELSKFCQSNETTQHCLLRLVREAIERSGRHVESSTIRRRSILVKLTDTINGVADDEPDLTLDIVPVIPQTYKSGELDQYTDPLWIADKDLDQWLSTYPNSQLSDSESRNEESSYLVDRHHYKPLVKITKAWKKVHFGSQKTPKGFFLECMVAEFHNPDAESWILALRDMLKNVCDTWGNPDYFIASPTVADISKSSANRIPLVKVEKPEDLDRAKNIVKKMRRHLELIEQAIDEADTDLNKAARTLQLVLGSDPDDIIFPLPASDKSTSSDSTKKDEPSRVAIPVVKINNPNKPWGYDGTRINN

SEQ ID NO: 4104 - protein, 382 aa, Chloroflexi bacterium
MTTLNDLFIEYLGSIQPYAKAVERAQIAHTCLREDLEDDESLGAHMLNSFLSGSYGRSTAIKGIKDVDIVIPFDYTFEELAELCQSNETSQHCLLRLVREAIDRSGRHVVSSIIRRRSILVKLADTVNGVTDDEPDLTLDIVPVIPQTYSSGELDQYTDPLWIADKDLDQWLSTYPNSQLSDSESRNEESSYLVDRHHYKPLVKIMKAWKKVHFGSQKTPKGLFLECMVAEYHNPDATSWILALRDMLKKACDTWGTPDYFIASPTVADISKSSVNRIPLVKVEKPEDLDRAKNIVKKMRRHLELIEQVIDEADTDLNKAAITLQLVLGSDPDDIVFPLPKSDKNSSSDSTKKDEPSRMAIPVVTINNPNKPWGCDGTRFNN

SEQ ID NO: 4105 - protein, 340 aa, Acidipropionibacterium acidipropionici
MENLMAHLRQQFKAALTSIEPGDDKANAPEAHQLVRNALRADTKLADYGVDPVLIGSYKRNVSIRRIKDVDVFVRLPEVPKDVTSKEILDQFFTVLHAKFGSDADGHRRTKRQDRSLQVSFPEYDLHVDAVPARPYWDGETWEIPQKGDEDKWVRTNPEKLTSLSSEMNAEHDDYYVPTVKLLRQTRRSILGAGKKPGGFFIEVATYQAFASGLVSGTDHAEYYVSALEKVSKIIDDYVSREIGVNDPTLPGHTISIRATDDELEAARTRFADAAETAREALEEENEGKAALAFRKLLGKNGDDETVFPMPPGFGEDGSKRASVISAGARTVPAGRRTFG

SEQ ID NO: 4106 - protein, 336 aa, Acidipropionibacterium acidipropionici
MAHLRQQFKAALTSIEPGDDKANAPEAHQLVRNALRADTKLADYGVDPVLIGSYKRNVSIRRIKDVDVFVRLPEVPKDVTSKEILDQFFTVLHAKFGSDADGHRRTKRQDRSLQVSFPEYDLHVDAVPARPYWDGETWEIPQKGDEDKWVRTNPEKLTSLSSEMNAEHDDYYVPTVKLLRQTRRSILGAGKKPGGFFIEVATYQAFASGLVSGTDHAEYYVSALEKVSKIIDDYVSREIGVNDPTLPGHTISIRATDDELEAARTRFADAAETAREALEEENEGKAALAFRKLLGKNGDDETVFPMPPGFGEDGSKRASVISAGARTVPAGRRTFG

SEQ ID NO: 4107 - protein, 336 aa, Propionibacterium freudenreichii
MAHLRQQFKAALTSIEPGDDKGNAPEAHQLVRNALRADTKLADYGVDPVLIGSYKRNVSIRRIKDVDVFVRLPEVPKDVTSKEILDQFFTVLHAKFGSDADGHRRTKRQDRSLQVSFPEYDLHVDAVPARPYWDGETWEIPQKGDEDKWVRTNPEKLTSLSSEMNAEHDDYYVPTVKLLRQTRRSILGAGKKPGGFFIEVATYQAFASGLVSGTDHAEYYVSALEKVSKIIDDYVSREIGVNDPTLPGHTISIRATDDELEAARIRFADAAETAREALEEEDEGKAALAFRKLLGKNGDDETVFPMPPGFGEDGSKRASVISAGARTVPAGRRTFG

SEQ ID NO: 4108 - protein, 336 aa, Brevibacterium casei
MAHLKEQFKDALSSIEPGDDKANAPEAHRLVRDALEADTKLAEYGVDPVLIGSYKRSVSIKRVKDVDVFVRLPDVPNDVTSKDILDRFFTVLHAEFGSDDDGHRRTKRQDRSLQVSFPEYDLYVDAVPARPYRDGETWEIPQKGDADKWVRTNPEKLTSLSSEMNAAHEGYYIPTVKLLRQTRRSILGAGKKPGGFFIEAATYQAFASGLVSGNDHAEYYASALEEVNKIIANYVSYGVGVDDPTLPGRMISIRATDDELDAAKTRFADAARVAREALDEEDEGEAALAFQKLLGKNGDDETVFPMPPGFNEDGSKRASAISAGARTVPAGARTFG

SEQ ID NO: 4109 - protein, 336 aa, Tetrasphaera japonica
MAHLKQQFKDALSSIEPGDDKANAPEAHQLVRDALQADAKLTEYGVSPVLIGSYKRSVSIRRVKDVDVFVRLPDVPSDVTSKDILDRFFTVLHAEFGSDADGHRRTKRRDRSLQVSFPEYDLYVDAVPARPYWDGETWEIPQKGDADKWVRTNPEKLTSLSSEMNTAHDGYYVPTVKLLRQTRRSLLGVGKKPGGFFIEVATYQAFVSGLVSGSDQAEYYVSALEEVSKIIGNYVSYGIGVNDPTLTGHTISIRATDDELDAARTRFADAAEAARGALDEEDEGKAALTFRKLLGKNGDDETVFPMPAGFNDDGTKRESAISAGARVVPAGTRTFG

SEQ ID NO: 4110 - protein, 336 aa, Tetrasphaera japonica; identical to SEQ ID NO: 4109

SEQ ID NO: 4111 - protein, 335 aa, Tsukamurella tyrosinosolvens
MAHLRQQFKDALSSIEPGDDKVNAPEAHRLVRDALEADAKLAEYGVNPVLIGSYKRNVSIKRVKDVDVFVRLPDVPSDVTSKDILDRFFAVLHAEFGTDPDGHRRTKRQDRSLQVSFPEYDLYVDAVPARPHWDGDTWEIPQKGDMDTWVRTNPETLTSLSSEMNAAHDAYYVPTVKLLRQTRRSLLGAKKPGGFFIEVATYQAFASGLVSGNDHVEYYVSALEEVSQTIDGFVSYGIGVNDPTLAGHTISIRATSEELDAARTRFADAAESARGALKEEDEGKAALIFQELLGENGDGERVFQMPRGFNDDGSKRVSAISAGARVVPAGTRTFG

SEQ ID NO: 4112 - protein, 336 aa, Microbacterium testaceum
MAHLKQQFKDALSSIEPGDDKANAPEAHRLVRDALEADAKLAEYGVDPVLIGSYKRNMSIKRVKDVDVFVRLPDLPSDVTSQDILDRFFTVLHAEFGSDGDGHRRTKRQDRSLQVSFPEYDLYVDAVPARPYWDGETWEIPQKGDKDEWVRTNPEKLTSLSSEMNSAHDGYYVPTVKLLRQTRRSILGAGKKPGGFFIEVATYQAFASGMVSGNDHAEYYVSALEEVSKIIDGYVTFGLGVNDPTLPGHAISIRATDDELDAAKSRFADAAETAREALDEEDEGKAALAFQRLLGKNGDDETVFPMPPGFNEDGSKRASAISAGARTVPAGTRTFG

SEQ ID NO: 4113 - protein, 336 aa, Microbacterium sp.
MAHLKQQFKDALSSIEPGDDKANAPEAHRLVRDALEADAKLAEYGVDPVLIGSYKRNVSIKRVKDVDVFVRLPDLPSDVTSQDILDRFFTVLHAEFGSDGDGHRRTKRQDRSLQVSFPEYDLYVDAVPARPYWDGETWEIPQKGDEDEWVRTNPEKLTSLSSEMNSAHDGYYVPTVKLLRQTRRSILGAGKKPGGFFIEVATYQAFASGMVSGNDHAEYYVSALEEVSKIIDGYVTFGLGVNDPTLPGHAISIRATDDELDAAKSRFADAAETAREALDEEDEGKAALAFQRLLGKNGDDETVFPMPPGFNEDGSKRASAISAGARTVPAGTRTFG

SEQ ID NO: 4114 - protein, 336 aa, Micrococcus sp.
MAHLKQQFKDALSSIEPGDDKANAPEAHRLVRAALEADAKLAEYGVDPVLIGSYKRNVSIKRVKDVDVFVRLPDLPSDVTSKDILDRFFTVLHAEFGSDGDGHRRTKRQDRSLQVSFPEYDLYVDAVPARPYWDGETWEIPQKGDEDEWVRTNPEKLTSLSSEMNSAHDGYYVPTVKLLRQTRRSILGSGKKPGGFFIEVATYQAFASGLVSGNDHAEYYVSALEEVSKIIDGYVTLGIGVNDPTMAGHTISIRATDDELDAAKTRFAEAAETARDALDEEDEGKAALAFQGLLGKNGDDDTVFPMPPGFNEDGSKRASAISAGARTVPAGTRTFG

SEQ ID NO: 4115 - protein, 336 aa, Arthrobacter sp.
MAHLIQQFKDALSSIEPGDDKANAPEAHQLVRQALGADAKLAEYGVDPVLIGSYKRSVSIKRVKDVDVFVRLPDLPSDVTSKDILDRFFKVLHAEFGVDSSARRRTVRQDRSLKIAFPEYDLDVDAVPARPHWDGTTWEIPQKGHEDKWVQTNPEVLTSLSSEMNAAHGGYYVPTVKLLRQTRRALLRRGAKPGGFFIEVATYQAFKSGLVSGNDHAEYYVSALEEVAKIINNFVVYGIGVTDPTLWGKTISIRATEDELETARVRFGDAAASARSALKEEDAGKSALAFQKLLGKNGDDDTVFKMPPGFNEDGTKRATAISAGARTVPAGMRTFG

SEQ ID NO: 4116 - protein, 335 aa, Microbacterium profundi
MAHLKQQFKDALSSIEPSDDKTNAPEAHRLVRDALEADAKLTEYGVSPVLIGSYKRNVSIKRIKDVDVFVRLPDMPSDVTSKDILDRFFAVLHAEFGTDSDGHRRTKRQDRSLQVSFPEYDLYVDAVPARPHWDGETWEIPQKGDENEWVRTNPEGLTSLSSEMNAAHDGYYVPTVKLLRQTRRAQLGKKKPGGFFFELATYQAFASGAVSGSDQAEYYVSALTKVSKIIENFVTYGIGVNDPTLAGATIHIRASDEELEAARTRFADAAISADDALAEEDEGKAALAFQKLLGKNGDDKMVFPMPPGFNEDGSKRASAILAGARVVPAGTRTFG

SEQ ID NO: 4117 - protein, 335 aa, Microbacterium pygmaeum
MAHLKQQFKDALSSIEPGDDKANAPEAHRLVREALAADAKLAEYGVNPVLIGSYKRSVSIKRVKDVDVFVRLPDLPSGVTSKEILDRFFTVLHAEFGRDDDGHQRTKRQDRSLQVSFPDYDLYVDAVPARPHWDGETWEIPQKGDDNQWVRTNPESLTSLSTAMNTAHDGFYVPTVKLLRQTRRAILGKKKPGGFFFEVATYQAFASGLVAGSDHAEYYASALDEVSKIVENFVTYGIAVSDPTLPGHTIGIRASEDELEAARSRFINAAADARDALEEEDEGKAALAFQKLLGKNGDDDTVFPMPPGFNDDGSKREFAISAGERVVPAGARTFG

SEQ ID NO: 4118 - protein, 336 aa, Kocuria rhizophila
MTHLRQQFKDALGSIEPGDDKANAPMAHQLVRDALEADAKLSAYGVSPVLIGSYKRNVSIRRVKDVDVLVRLPNVEGDVTSKDILDRFFTVLHAEFGSDADGHRRTKRQDRSLQVSFPEYDLYVDAVPARPYGDGETWEIPQKGDADKWVRTNPEKFTSLSSEMNSAHDGFYVPTVKLLRQTRRSALGVGRKPGGFFIEVATYQAFASGMVSGNDHAEYYVSALDEVSKIIDSYVSYGTGVNDPTLPGHTISIRATDDELEAAKTRLADAAKAARGALEEEDEGMAALAFQKLLGKNGDDEIVFPMPPGFNEDGSKRASAISAGARVVPAGTRTFG

SEQ ID NO: 4119 - protein, 361 aa, Streptomyces sviceus
MRPASHCQWCEASSAGQCRHKPRSEGPMAHLKQQFKDALSSIEPGDDKTNAPEAHRLVRDALEADSKLAEYGVSPILIGSYKRNVSIRRIKDVDVFVRLADVPRDVTSTDILDRFFKVLHAEFGTDSDGHRRTKRQDRSLQVSFPAYDLYVDAVPARPYGDGTWEIPQKGDANEWVRTNPDGLTELSSAMNADHDEYYVPTVKLLRQTRRALLGTKKPGGFFIEMAVYQAFASGAVSGNDQAEYYVRALREVSRIIDDFVTYGIAVTDPTLPGHTIRIRATDDELDTARTRFTDAAASAEAALTEEDAGQAALAFRKLLGTNGDGDTVFPMPPGFNEDGSKKASAISPGARVVPAGKRTFG

SEQ ID NO: 4120 - protein, 334 aa, Streptomyces sviceus
MAHLKQQFKDALSSIEPGDDKTNAPEAHRLVRDALEADSKLAEYGVSPILIGSYKRNVSIRRIKDVDVFVRLADVPRDVTSTDILDRFFKVLHAEFGTDSDGHRRTKRQDRSLQVSFPAYDLYVDAVPARPYGDGTWEIPQKGDANEWVRTNPDGLTELSSAMNADHDEYYVPTVKLLRQTRRALLGTKKPGGFFIEMAVYQAFASGAVSGNDQAEYYVRALREVSRIIDDFVTYGIAVTDPTLPGHTIRIRATDDELDTARTRFTDAAASAEAALTEEDAGQAALAFRKLLGTNGDGDTVFPMPPGFNEDGSKKASAISPGARVVPAGKRTFG

SEQ ID NO: 4121 - protein, 334 aa, Streptomyces scabiei
MAHLKQQFKDALSSIEPGDDKTNAPEAHRLVRDALKADSKLAEYGVSPILIGSYKRNVSIRRIKDVDVFVRLPDVPSDVTSTDHLDRFFKVLHAEFGTDADGHRRTKRQDRSLQVSFPEYDLYVDAVPARPYGDGTWEIPQKGDANEWVRTNPDGLTDLSSTMNADHDEYYVPTVKLLRQTRRALLGTKKPGGFFIEMAAYQAFASGAVSGNDQAEYYVSALREVSKIIDNFVTYGIAVTDPTLPGHTIRIRATDDELDTARTRFTDAAASAEAALDEEDAGKAALAFQKLLGTNGDGDTVFPMPPGFNEDGSKKASAISPGARVVPAGKRTFG

SEQ ID NO: 4122 - protein, 334 aa, Streptomyces nanshensis
MAHLKQQFKDALSSIEPGDDKTNAPKAHRLVRDALEADSRLAEYGVSPVLIGSYKRNVSIRRIKDVDVFVRLADVPGEVTSKNILDRFFKVLHAEFGTDADGHRRTKRQDRSLQVSFPEYDLYVDAVPARPFGDGTWEIPQKGDGNEWVRTNPDGLTELSSTMNADHDEYYVPTVKLLRQTRRALLGKKKPGGFFIEMAAYQAFASGAVSGNDQAEYYVCALREVSTIVDSFVTYGIAVTDPTLPGHTIRIRATDDELDTARTRFADAATSAQAALDEEDAGKAALAFRKLLGVNGDGDTVFPMPPGFNEDGSKKASAISPGARVVPAGKRTFG

SEQ ID NO: 4123 - protein, 334 aa, Streptomyces pactum
MAHLKQQFKDALSSIEPGDDKTNAPKAHGLVRDALEADSRLAEYGVSPVLIGSYKRNVSIRRIKDVDVFVRLADVPGEVTSKDILDRFFKVLHAEFGTDADGHRRTKRQDRSLQVSFPEYDLYVDAVPARPFGDGTWEIPQKGDGNEWVRTNPDGLTELSSTMNADHDEYYVPTVKLLRQTRRALLGKKKPGGFFIEMAAYQAFASGAVSGNDQAEYYVCALREVSTIVDSFVTYGIAVTDPTLPGHTIRIRATDDELDTARTRFADAATSAQAALDEEDAGKAALAFRKLLGVNGDGDTVFPMPPGFNEDSSKKASAISPGARVVPAGKRTFG

SEQ ID NO: 4124 - protein, 334 aa, Streptomyces prunicolor
MAHLKQQFKDALSSIEPGDDKTNAPEAHRLVRDALKADAKLVEYGVSPVLIGSYKRNVSIRRIKDVDVFVRLPDVPSDVTSTDILDRFFKVLHAEFATDADGHRRTKRQDRSLQVSFPEYDLYVDAVPARPYGDGTWEIPQKGDANEWVRTNPDGLTELSSTMNANHDEYYVPTVKLLRQTRRALLGKKKPGGFFIEMAAYQAFASGAVLGNDQAEYYVCALREVSKIIENFVAYGIAVTDPTLPGHTIRIRATDAELDSARTRFTDAAASAEAALDEEDEGKAALAFRKLLGENGDGDTVFPMPPGFNEDGSKKASAISPGARVVPAGKRTFG

SEQ ID NO: 4125 - protein, 196 aa, Streptomyces sp.
MAHLKQQFKDALSSIEPGDDKTNAPEAHRLVRDALKADSKLAEYGVSPILIGSYKRNVSIRRIKDVDVFVRLPDVPSDVTSTDILDRFFKVLHAEFGTDADGHRRTKRQDRSLQVSFPEYDLYVDAVPTRPYGDGTWEIPQNGRRERVGAHQPRRADGPLEHDERGPRRVLRTDRQTASPDSSRPARHEEARRILH

SEQ ID NO: 4126 - protein, 336 aa, Mycobacterium heidelbergense
MAHLKQQFRDALGSIEPGDDKAHAPEAHNLVRDALEADPTLAGYGVSPVLIGSYKRNVSIKRIKDVDVFVRLPEVSAEVSSRDILDRFFKVLHAEFGADSDGHRRTKRQDRSLQVSFPEYDLYVDAVPARPYVDGQTWEIPQKGDEDQWVRTNPEALTTLSSAMNANHDGFYVPTVKLLRQTRRALLGVGTKPGGFFIEAATYQAFNSGLVGGDDQAEYYVSALQQISTIINNFATYGIEVSDPTLLGHTISIRATDDELEAARSCLADAAAAARDALIDEDEGAAALTFQKLLGENGDGDTVFKMPPGFNEDGTKRASIISPGARVVPAGPRTFG

SEQ ID NO: 4127 - protein, 335 aa, Isoptericola dokdonensis
MAHLNSQFKDALGNIEPSDDKVNAPEAHKTVRAALEADPTLAGYRVDSVLIGSYKRNVAIRRVKDVDVFVRLPDISEDVTSSEILDRFFKVLHAEFGTDDDGHRRTKRQDRSLQVSFPEYDLYVDAVPARPYGDGETWEIPQKGDDDEWVRTNPEALTSLSSEMNKAHDGFYVPTVKLLRQTRRALLGKHKPGGFFIEAATYQAFKNGEVAGSDQAEYFVSTLRAVSTLIKSFVDYGIGVDDPTLPSSKITIRATDDELTTARDKFDDAAAAAEDALAEADEGKAALAYRELLAKNGDDEIVFPMPPGYNEDGTKRASLISAGDRLVPAGKRTFG

SEQ ID NO: 4128 - protein, 332 aa, Microbacteriaceae bacterium
MARLRQQFKDALSSIEPSDVDRSNAPEAHRLVREALMADDTLKGYGISPVLIGSYKRSVSIRRVKDVDVLVRLPDLPQDVTADKILDCVVNVLRAEFGTDSVKRQARSVKVAFPDYDLDVDAVPARPCFVGDGTWEIPVKNSEDEWIRTNPEKLTELSTEMNSEHAEFYVPTVKLLRQTRRTLLAKGARPSGFTIEAAAYEAFRSGVVGDDNATFYVSALEGVSAILTNLAKYGIGIPDPTLSGATIQTNATADELNTVSDRFAVAAVDAAAALTEDDLGKSALVFQKLFGVNGDGKTVFQTPDGFDEKGRAKAGTITSGAATVPAGTRTFG

SEQ ID NO: 4129 - protein, 322 aa, Unknown
  Description of Unknown: Nocardioides sequence
MAILTSKFKDALTRIEPSDADIKNAPLAHNEVRDALADATGLDDWDVKPILIGSYARSVAIRRVKDVDVFCRMYDIGDDVQPVTVLNRFYKALEDAFGSARVTRNARSFKVTFPEYDDLHVDAVPARQNWDGTWEIPTKDGEWQPTNPLNVNELTTAMNKNHNGMYVPTVKLARQARRAINDARPGGFFVEMCLYDAFLNRKVDTASHALAFVTALEAIADYLDAKVGWGKKLPDPSRPGYDMFFRATDKQWETARDKFRAAATKARDAYKNDDEHEAAKAYRDLLGVNGDGDDVFPEVPKAAARLITPGAHNVPAGDRRFG

SEQ ID NO: 4130 - protein, 336 aa, Demequina sp.
MAILSSQFSAALVSIEPSADDKKNAPEAHKELRAALTGADELKEWGIDPVLIGSYKRDVSIRRVTDVDVFCRMEDIGDDVAGDTVLDRFFTVLDAEFGTDANGKKRTRRQARSITVDFPEYDGLHVDAVPARRRTDGHWEIPTREGGWQTTNPERQTELKTAMNDAFADDYVPLVKLIRQTRRTIIGKHPGGLFAELALYDACSNGKVSKSSLTLSYVTALEAIAAYLDDKVNWGKGLPDHTMPGHSLEFRATDNQWETARDNFASAAALAREAYNEEDSGKAAVAFRELLGVNGDGDVVFPMPDGYTEDGTKSAAASAIITPGSPSVPAGDRRFG

SEQ ID NO: 4131 - protein, 340 aa, Cellulomonas gilvus
MPQLTSQFTQALRRVEPTSDDKSNAPKAHTDVRDVLLADETLCGWGLDPILIGSYKRHVSIRRVKDVDVFGRLTELPDDVPPASLLKEFERVLKAEYGDRVARQARSLQVSFPDLDGLYVDAVPARAWASPFGEDAWQLPKRGEAGWQATNPERLTELVSELNGQFDQRFVHVVKLLRQTRRSLLGKRKPGGLTIEMATVLAFQSGAVTGATLTDLYVSALREVGTLLYNAFHVGLGLPDPTLTGEYLVVRGEDDDKQALADEFVAAGRRAQEARDAADRDKCQAALTFRRILGKAVDDHGDQDYVFPMPDDCNLDGTSKDFERVRAGDRTVAGGDRRFG

SEQ ID NO: 4132 - protein, 349 aa, Unknown
  Description of Unknown: Micromonospora sequence
MPALVTQFDEALRNIEPTEADKTNAPLAHAEVSDALADDSVIAGWGFERLLIGSYKRHVSIRRIKDVDVFGRLTEVGSDVLPSTLLGEFERVLRKAFPPVDGKTRVHRQARSLQVSFPEYDGLYVDAVPARPWTSPTGVEAWQLPKREDGDDPQGWQATNPHELTRLTSELNNADNFDGFYVPTIKLLRQTRRSLVGKRKPGGLTVEIAALHAFRTGLVEGPTQADYYASALRETGNVLHDAFVLDFGLDDPTIPGEKVAVRAEDEDKRDLANAFLDAADRAEEALASDNRCAAAKAFRDLLGKAVDDQGDNDYVFPMPADCNADGTAKRFASVTAGDRAVPAGNRRFG

SEQ ID NO: 4133 - protein, 330 aa, Knoellia sp.
MAELATSFATAQSNVEPSDDDWDNAPEAHDAINKVLAADETLKGWGINPILIGSYGRRVSIRRVYDIDMFCRLDDYPEGVSAQDVLDQVYAVLVAEYHKDAVTLEDRSVTVLVPDADGLYVDVVPARKSGTVWEIPTDDGDWVVTNPVVMSELKEAKNANFDEMYVPCVKLLRQARRNLLGTAKPGGFAVEMALYTACDEAQVNPSASMAELFTTALEGVADVFRRMADEGFAIPDPSMPGEEMTFDPDADFDTARDKFTTAAADAREAYAMDEDQAGKAALLLQGILGSNDDFENVFPMPSGYDDDGNRTTSDRSAGSRSATAGTLRFG

SEQ ID NO: 4134 - protein, 311 aa, Rhodococcus fascians
MAELATQFKTAQSNIEPSADDWDNAPSAHDEVSTVLAADEKFKEWGINPILIGSYGRRVSIRRVYDVDMFCRLDDYPTDVDASEVLGRAYNVLVDQYGDNHVTLYDTSITVLIPDADGLYIDVVPARKAEDVWEIPTDNGWLKTNPIKLTELKEAKNADYDELYVPCVKLLRQARRTLMGQEAKPGGFTVEMALFTACEEGQVSGQSMAELFASAVEGVADVFRRIADDGFEIPDPTMGGEVLSFDEGADFETARDTFAAAAADARAAYDMAEDQAGKAALLLQGILGANDDFDNVFPMPAGYSPNGDPKA

SEQ ID NO: 4135 - protein, 331 aa, Rhodococcus fascians
MAELATQFKTAQSNIEPSADDWDNAPSAHDEVSTVLAADEKFKEWGINPILIGSYGRRVSIRRVYDVDMFCRLDDYPTDVDASEVLGRAYNVLVDQYGDNHVTLYDTSITVLIPDADGLYIDVVPARKAEDVWEIPTDNGWLKTNPIKLTELKEAKNADYDELYVPCVKLLRQARRTLMGQEAKPGGFTVEMALFTACEEGQVSGQSMAELFASAVEGVADVFRRIADDGFEIPDPTMGGEVLSFDEGADFETARDTFAAAAADARAAYDMAEDQAGKAALLLQGILGANDDFDNVFPMPAGYSPNGDPKAHVTERKPGDRKPTPGNLRFG

SEQ ID NO: 4136 - protein, 320 aa, Microbacterium ketosireducens
MSVLTKQFKDALSQVEPGEDAAHAAEAHAEVRDVLHGHSDLVEWGLHSVLIGSYRREVSIRRVKDVDVFCELPSLPEDQDPQDLLDKFARLLADEYGDRVTKNDRSVKVDFPDFDMHVDVVPARAAGDEWEIPDRDGGWEKTHPVKFSELSTARNQAHDEKYVPVVKLLRQTRRALLGEAKPGGFFVEIAAYHSFASIPDGNSDDSPNSTAEYYTVALEKMAPILRDHADDVARLMNPAIPEQELHVRATRAELDAIADKWEQAAVDAREALESENDQDAARTFKRLLGQNSDGDDVFEVPVVVSAGHRSLPSGESPTFG

SEQ ID NO: 4137 - protein, 338 aa, Streptomyces mirabilis
MAALPTQFGEALSTVEPDEDAAHAQVAHAQVSKVLEGDERLRGLGVDPLLIGSYKRHVSIKRVKDVDVFARLTKADGSLRPGAILDHVADILGVAFPGDVERQHRSVKVDFPDYDLSVDVVIARPCGDHWEIPQRVEEDGRARWVETNPTKMTELTTEANKSFLLYDDDDDSGVYVRIVKLVRQVRRTWVNDQPGGYYFEVLTYHAFQELQPDEQTVAAYLTRILRRIAEMLPEHVDEGPVDPTLPDKTIKTKATAEQIEAAADQMAKAADLAEAALDEEDRCVSAVKWRQLLGTTQNTEVPEDVFPLPGYCNADGTIKNRSVIKGAPAVPAGQDRYA

SEQ ID NO: 4138 - protein, 343 aa, Kocuria turfanensis
MATHATQFNKALSNIEPAEDADHAKGAHKEVSEVLKADERLRGLGVSPVLIGSYKRDVSIRRVKDVDVFVRLQDAGKDLRPGDILDHITEVLEEAFEDRVTRQHRSVMVDFPDLDLSVDAVIARPCVEHPEEHWQIPQRIEDDGNARWIETNPTAMTEHTTEANQTFLLGASNEGKGVYVPVVKLMRQIRRTWVKDQPGGYYFEVLTWHAFQENQPQESTVAEYLTVILRAVAEALPECAETGPDDPTLEGKTIKSKATAEQIKAAADRIAEAADLAEQALAETDMCRAAKLWQELLGTTHGTETAELVFPMPEYCNADGTQKQSTTITRGAPAVPAGRDRYA

SEQ ID NO: 4139 - protein, 338 aa, Actinoplanes atraurantiacus
MATLATHFKTALSNIEPSEDAANAQSAHAEVTKVLKADNLLARLGVDPLLIGSYGRQVSIRRVKDVDVFVRLRKAGKDLRPGRILDHVTAVLEEAFPDRVTRQHRSVMIDFPDDDLSVDVVIARPCGDHWEIPQKIEDDGNARWVETNPTKMAELTTQANKDYLLYEGDPGSGVYVPVVKLMRQIRRTWVEDQPGGYFFEVLTYHAFSNLKPNEKSYAEYVTVVLREIADLLVDVADDGLDDPTLDGKKIKTKATPEQLAAAAARIDEAASLAEEALKADDCSAAAKWRELLGTTKNTRTEEQVFPLPEYCNADGSRKKMTAVTRGASTVPAGSGRYA

SEQ ID NO: 4140 - protein, 332 aa, Mycobacterium sp.
MTELAPYFKEALSTIEPDDDKKNAATAHAEVRDVLTADEGLSNLGVDPVLIGSYARNVSIKHVKDVDVFARLQDASDTLAPGAVLDTFEKILTDEYEDRVERQHRSIKVDFPDFNLTVDAVPARPAGDNWEIPNKPEDVERAQWVETNPLKLNDLTSEKNGEFLLNGKGIYVPIVKLVRQVRRTWLGDQPGGLFFELMTYWYFQNENPSASSVAEYLTLTLEGIADMLPDLASDGLDDPTINGEKIATKATDDDLATAEEKIREAAELARSAFDDEDDCTSAVKWQKLLGVTSGGDDVFPLPSYCNADGTYKKSASITSGAATVPAGDGRYA

SEQ ID NO: 4141 - protein, 332 aa, Mycobacterium sp.
MTELATCFRDALATIEPDEDKDNAADAHAEVREVLTADAGLKEWGIDPVLIGSYARHVSIKHVKDVDVFARLSEADDSVGPGAVLDAFEEVLKDEYEERVERQYRSIKVDFPDFGLTVDAVPARPCGDDWEIPNKPEDAQRARWVKTNPLKLNSLTTDLNSEFLLNDAGIYVPIVKLVRQVRRTWLGDQPGGLFFELMTYWFFENEKPSALSVAEYLAVALEGIAEMLPTVASDGLDDPTLNGEKISTKATASDLATATERIEEAAEVARDALDDPDDCTSAVKWRGLLGVTSAGDEIFPLPSFCNADGTHKRAASITPGSTRVPAGDDRYA

SEQ ID NO: 4142 - protein, 333 aa, Unknown
  Description of Unknown: Rhodococcus sequence
MATLAGRFDDALTTIEPDDDKANAATAHAEVRDVLEADEGLAKLGIDPVLIGSYARQVSIKHVKDVDVFARLTDADETLAPGMILDAFENVLIEEYGEDRVEKQYRSIKVDFPDFDLTVDAVPARACGENWEIPNKPEDVERAQWVETNPLKLNDLTTEKNSEFLLNGEGIYVPIVKLIRQVRRTWLEDQPGGLFFELMTYWFYENEKPSATSVAEYLTLTLDGIAEMLPSVAADGLDDPTLPGEKISTKATDEDLENAQERIREAADLAADALADEDNCSSAVKWRKLLGETSDGDYVFDLPSYCNEDGSRKNLASVTSGAARVPAGDDRYA

SEQ ID NO: 4143 - protein, 372 aa, Unknown
  Description of Unknown: Rhodococcus sequence
MTLVLMTEMLFGYAFSGIIMPNRLTGHSIKVDLAGRRFSMATLAGRFDDALTTIEPDDDKANAATAHAEVRDVLEADEGLAKLGIDPVLIGSYARQVSIKHVKDVDVFARLTDADDTLAPGMILDSFENVLIEEYGEDRVEKQYRSIKVDFPDFDLTVDAVPARACGENWEIPNKPEDVERAQWVETNPLKLNDLTTEKNGEFLLNGEGIYVPIVKLIRQVRRTWLEDQPGGLFFELMTYWFSENEKPSATSIAEYLTLTLDGIAEMLPSVAADGLDDPTLPGEKISTKATDEDLENAQERIREAADLAADALADEDNCSSAVKWRKLLGETSDGDYVFDLPSYCNEDGSRKNLASVTSGAARVPAGDDRYA

SEQ ID NO: 4144 - protein, 359 aa, Mycobacterium sp.
METLDTEFAQAVRNVSIHGDKRDRAIAAHTEVRELLEADAELKGWGIDTRLIGSYARLTARYPGKDVDVFLRFTGLSVRHSPEKIYNAVERVLVDEYGVKGEDLGGRITRQARSLKIDFPEPEGHFSDDAFAIDAVPAVPWGEHWAIPNRDRDQWNNDEGRWIKTNPVQFATDTDALATASSSPTIGGENAYRHIVRLLRQVRHFHLGGQRPGGLFVEIAAYYVWKEQLVSGTTHAELLTSTMQHVGARLIDCADDGLPDPVLGTPLKPDLDPWQWRSAGQTFERLAGEARTALDSERCRAAKLWRDILGTNDRGQVLPLPDGCDAAGFPIGAVTAVGALGSNQPRGFATPDSWLEARR

SEQ ID NO: 4145 - protein, 359 aa, Unknown
  Description of Unknown: Mycobacterium sequence
METLDTEFAQAVRNVSIHGDKRDRAIAAHTEVRELLEADAELKGWGIDTRLIGSYARLTARYPGKDVDVFLRFTGLSVRHSPEKIYNAVERVLVDEYGVKGEDLGGRITRQARSLKIDFPEPEGHFSDDAFAIDAVPAVPWGEHWAIPNRDRDQWNNDEGRWIKTNPVQFATDTDALATASWSPTVGGENAYRHIVRLLRQVRHFHLGGQRPGGLFVEIAAYYVWKEQLVSGTTHAELLTSTMQHVGARLIDCAADGLPDPVLGTPLKPDLDPWQWRSAGQTFERLAGEARTALDSERCRAAKLWRDILGTNDRGQVLPLPDGCDAAGFPIGAVTAVGALGSNQPRGFATPDSWLEVRR

SEQ ID NO: 4146 - protein, 360 aa, Unknown
  Description of Unknown: Mycobacterium sequence
MMETLDTEFAQAVRNVSIHGDKRDRAIAAHTEVRELLEADAELKGWGIDTRLIGSYARLTARYPGKDVDVFLRFTGLSVRHSPEKIYNAVERVLVDEYGVKGEDLGGRITRQARSLKIDFPEPEGHFSDDAFAIDAVPAVPWGEHWAIPNRDRDQWNNDEGRWIKTNPVQFATDTDALATASSSPTIGGENAYRHIVRLLRQVRHFHLGGQRPGGLFVEIAAYYVWKEQLVSGTTHAELLTSTMQHVGARLIDCADDGLPDPVLGTPLKPDLDPWQWRSAGQTFERLAGEARTALDSERCRAAKLWRDILGTNDRGQVLPLPDGCDAAGFPIGAVTAVGALGSNQPRGFATPDSWLEARR

SEQ ID NO: 4147 - protein, 359 aa, Unknown
  Description of Unknown: Mycobacterium sequence
METLDGEFAKAVRNVSIHGDKRDRAIAAHTEVRNLLEADAELKNWGIDTRLIGSYARLTARYPGKDVDVFLRFTELSVRHSPEKIYNAVERVLVDEYGVKGEDPGGRITRQARSLKIDFPEPEGHFSDDAFAIDAVPAVPWGDHWAIPNRDRDQWNNDEGRWIKTNPVQFADDTNALATASWSPTVDGDNAYRHVVRLLRQVRHFHLAGQRPGGLFVEIAAYYVWNEQLVTGTTHAQLLATTMEHVGARLIDSAEDGLLDPVLGTPLKPALDPWQWTSAGQTFEQLAVQAREALDSERCRAAKLWRDILGTNDRGHVLPLPDGCDAAGFPVGAVTAVDALGSNRPRGFAMPTSSLQTCR

SEQ ID NO: 4148 - protein, 357 aa, Mycobacterium sp.
MTDLLNEEFAQAVRNVSIHGDKRDRAIAAHSEVRDLLEADAELRGWGIDTRLIGSYARQTARYPGKDVDVFLRFDNLSVRHSPEKIYDAVERVLVDGYGVKGEDEGGRVTRQARSLKIDFPDPEAHFSDVAFAIDAVPAVRCQSHWAIPNRDRDKWDSDEKRWIKTDPVQFADDTNTLATASWSPTVGGANAYRPVVRLLRQVRHVHLGGQRPGGLFVEIAAYYVWNERLVTGTSYPQLLASTFKHVGARLIDSAVGGLPDPVLGTPLKPVLEPWEWTSAGQTFERLAREAYAALDAERCRAAKLWRDILGTNDRGQVLPLPDGCDAAGFPVGSVTAVGALGSNRSRGFAVTAVRRR

SEQ ID NO: 4149 - protein, 356 aa, Rhodococcus fascians
MHPLNDEFAQAVRNVSIHGDKRDRAIAAHTEVRNLLEADPELGGWGIDTRLIGSYARQTARYPGKDVDVFLRFRNLSVRHSPEKIYNAVERVLVEEYGVKGEDPDGRITRQSRSLKIDFPDPEDHFSDVSFAIDAVPAVPWGDHWAIPNRDRDQWDNDEGRWIKTNPVQFADNTDTLATAPTSPTVGAVNAYRPIVRLLRQVRHVHLEGQRPGGLFVEIAAYYDWKQGLVTGTSWAELLASTMEHVAQRLLDSAQDGLPDPILGTPLKPALDPWQWTSAGQTFERLAGEAREALTAERCRAAKLWRDILGTNDRGQILPLPDGCDAAGFPIGSITAVDALGSNQPRGFALNRLHQR

SEQ ID NO: 4150 - protein, 357 aa, Unknown
  Description of Unknown: Rhodococcus sequence
MMHPLNDEFAQAVRNVSIHGDKRDRAIAAHTEVRNLLEADPELGGWGIDTRLIGSYARQTARYPGKDVDVFLRFRNLSVRHSPEKIYNAVERVLVEEYGVKGEDPDGRITRQSRSLKIDFPDPEDHFSDVSFAIDAVPAVPWGDHWAIPNRDRDQWDNDEGRWIKTNPVQFADNTDTLATAPTSPTVGAVNAYRPIVRLLRQVRHVHLEGQRPGGLFVEIAAYYDWKQGLVTGTSWAELLASTMEHVAQRLLDSAQDGLPDPILGTPLKPALDPWQWTSAGQTFERLAGEAREALTAERCRAAKLWRDILGTNDRGQILPLPDGCDAAGFPIGSITAVDALGSNQPRGFALNRLHQR

SEQ ID NO: 4151 - protein, 360 aa, Mycobacterium dioxanotrophicus
METLNDEFAQAVRNVTVHGEKRDRAIAAHTEVRGLLEADPELSDWGIDTILIGSYARQTARYPGKDVDVFLRFTNLSVHHSPEKIYNAVERVLVEQYGLKDEDSGGGRITRQSRSLKIDFPDPEEHFSDTSFAIDAVPAVPWQGHWAIPNRDRDKWDNDDKRWIKTDPVQFAADTNTLATASWSPIVGTTNAYRPIVRLLRQVRHVHLGGQRPGGLFVEIAAYYVWNDQLVTGTSWAELLASTLEQVSARLNDSAEDGLRDPVLGTPLKPALEYWQWTSAAQTFDRLATEARDALAAERCRAAKIWRDILGTNERGHVLLLPDGCDAAGFPVGSVTAVSAVGSNQPRGFALPDGTCVGRN

SEQ ID NO: 4152 - protein, 356 aa, Unknown
  Description of Unknown: Mycobacterium sequence
MQTLTEEFAQAVRNVTVNGDKRDRAIAAHTEVRELLEEDAELSGWGIDTRLIGSYGRQTARYPGKDVDVFLRFTKLSVHHSPEKVYDAVERVLVEAYGVKGEDEGGRITRQSRSLKIEFPEPEDHFSQDAFAIDAVPAVPRQEHWAIPNRDRDKWDNDDKRWITTNPVQFAEDTNTLATASWSPTVGGVNAYRPIVRLLRQVRHIHLPGQRPGGLFVEIAAYYAWNDQLIDGTSYAEMLASTLEHVAARLADSADGGLPDPILGTPLKPALDPWQWTNAASTFDRLAGQAREALDAERCRAAKIWRDILGSNERGQVLPLPEGCDAAGFPIGSITAVGALGSNQPRGFATSTAVAR

SEQ ID NO: 4153 - protein, 359 aa, Mycobacterium yongonense
MHTLNDEFAQAVRNVSIHGEKRDRAMAAHAEVRNLLEADDELCQWGIDTRLIGSYGRQTARYPGKDVDVFLRFTKLSVRHSPEKIYNAVERVLVDEYGVKGEDSGGRITRQARSLKIDFPDPGAHFSDIAFAIDAVPAVPWQSHWAIPNRDRGQWDNDDERWIKTDPVQFADDTNTLATASWSPMVGGANAYRPIVRLLRQVRHVHLGSQRPGGLFVEIAAYYVWNERLVSGSTYAELLASSFEHIGTRLIDSANDGLPDPVLGTALKPDLEYWQWTSAGQTFERLAREAREALDAERCRAAKLWRDILGDNDRGPILPLPDGCDAGGFPVGAVTAVGALGSNQPRSFAMPAPHRDTQR

SEQ ID NO: 4154 - protein, 139 aa, Mycobacterium abscessus
MPRPSVGAVGEPLLDRCVRAVEDLTEVRQLLEADAELSEWGIDTRLIGSYARQTARYPGKDVDLLLRFTALSVWHRPEKLYDAVERVLVEAYGVKGEDQGGRITRQSRSSKIEFQEPEDRFNQDAFAIDAVPAVPWQEH

SEQ ID NO: 4155 - protein, 359 aa, Brachybacterium squillarum
METLDNEFAQAVRNVTVSGFKRERAIAAHTEVRALLEVDPELSSWGIDSILIGSYARQTARYPGKDVDVFLRFMNLSVRHDPEKVYNAVQRVLIAEYGLKDRDVDGRVTRQARSLKIDFPDPDDLLSDNSFSIDAVPAVQWGEHWGIPNRDRDLWNSEEKRWIKTNPLKFAEDTNATAVATWSPTVGTTNAYRPVIRLLRQVRHVHFGNERPGGLFIEVAGYYVWKAQLVSGTTWAELLTSTMEQVAKRLEKCTDDGLPDPVLGTTMKPDLDAWQWASAADGLNRLAEQARQALDSERCRAAKMWRDILGSNDRGQVLPLPDGCDANGFPVGSVTAVGAVGSNDPRGFASLPWSTRRHK

SEQ ID NO: 4156 - protein, 365 aa, Saccharothrix espanaensis
MTTTLDAEFTQAVTNVTVNDKKLELAIAAHTEIRDLLNADEELRRWGISPYLIGSYGRQTARYPGKDVDVFLRFTNLSARHDPAKIYAAVERVLIAEYGSKDDDSEGRVTRQARSLKIDFPDPEEPAPYGATSFFDTSFSVDAVPAVPWQGHWGIPNRDRKQWNKEENQRWIKTDPIQFDKNTDALSVASWSPQVGSRNAYRPVVRLLRQVRHTHLRTQRPGGLFVEVAAFHVWQAQLVTGSTWAELLTSTLEQVAGQFTEYEQTGLPDPVFGTPMKPEVGFGLWTAAASYFSELAQQGREALDADPCRAAKIWRSVLGSNERGEVLILPDGCDANGFPLSAISAVTAVGSDQPRGFASDAGNRD

SEQ ID NO: 4157 - protein, 360 aa, Lechevalieria aerocolonigenes
MTTTLDKEFKQAVRNVTIRDEKQARAIAAHTEVRELLEADAELREWGINSILIGSYARLTARYPGKDVDVFLRFTELSARHDPAKIYNAVQRVLVAEYGLKGEDPNGRVTPQPRSLKIDFPDPDEPLGDTSFSIDAVPAVPLQGHWGIPNRDRQEWDKEDRRWIKTDPIQFADDTEALSVATWSPQVGGDNAYRPIVRLLRQVRHVHLGDRRPGGLFVEVAAFHVWKAQLVAGSTWADLLTSTLEQVAGKFADCATSGLPDPVFGTPMKPTLEPGLWTAAAHAFDGFATLARQALDADPCKAAKIWREILGTNDRGQVLVLPDGCDANGLPLGAISAVTAVGSDQPRGFASPTAPFITRG

SEQ ID NO: 4158 - protein, 349 aa, Microbacterium sp.
METLPRQFEAAVTNVTVSPDKTRLAIAAHTEVRELLESDEILKSWGVDSILIGSYARDTARHPGKDVDVFLRFRKLSIAENPEDIYNRVAEILIRRYGLVGEGGRGTLQARSVKVDFSPNDERADLEFSIDAVPAVPWGDDWGIPNRDRTSWSISDARWIRTNPVAFADESTKLSTDEASPTVQGRNAYKPIVRLLRQARHTHLGDLRPGGLYVEIAAFYAWGEGKVVGDSWATLLASSLREVATAFRDASVAGMNDPVLRTPLAPPLTAAQWTEASRIFGELADKADAALEPDECRAALLWREILGENERGPILPLPPGCAADGTRTPQASAVSRQGPDQARGFALIR

SEQ ID NO: 4159 - protein, 350 aa, Microbacterium sp.
MMETLPRQFEAAVTNVTVSPDKTRLAIAAHTEVRELLESDEILKSWGVDSILIGSYARDTARHPGKDVDVFLRFRKLSIAENPEDIYNRVAEILIRRYGLVGEGGRGTLQARSVKVDFSPNDERADLEFSIDAVPAVPWGDDWGIPNRDRTSWSISDARWIRTNPVAFADESTKLSTDEASPTVQGRNAYKPIVRLLRQARHTHLGDLRPGGLYVEIAAFYAWGEGKVVGDSWATLLASSLREVATAFRDASVAGMNDPVLRTPLAPPLTAAQWTEASRIFGELADKADAALEPDECRAALLWREILGENERGPILPLPPGCAADGTRTPQASAVSRQGPDQARGFALIR

SEQ ID NO: 4160 - protein, 349 aa, Microbacterium sp.
METLASQFEDAVSNVTISPDKQKLAIAAHTEVRNLLESDAVLREWGVDSILIGSYARQTGRHPGKDVDIFLRFTKLSIRDNPSVIYDRVAQLLIRQYGRVEDGGRVTLQSRSVKVDFGPPSARPDLGFSVDAVPAVPWGEHWGIPARDRTDWSDANTRWMKTSPVAFADASAALSTRTASPTVGDRNAYKPIVRLLRQVRHTHLGEARPGGLYVEIAAYYVWEANLVSGGSWAELLAASLRQVGIEFSKAITDGMADPILGTSLTPGLSAQQWRTAANLFIELADKADEASSSDRCRAAKIWREILGANERGQILPLPPGCAADGSVVPRITAVSAAGPTQARGFALST

SEQ ID NO: 4161 - protein, 348 aa, Microbacterium oxydans
METLPTQFTTAVSNVTISDDKERRAIAAHTEVRELLEADATLKSWDITPLLIGSYGRQTARYPGKDVDIFLRFLNLGIAFDPAVVYDEVSRVLLAEYGHVDDGGRVTPQPRSLKVDFASPNAQADLAFSVDAVPAVPWGRDWAIPNRDRSTWQNEADRWVRTNPVAFGEASQALSTSDKSPVVNGRNAYKPIVRLLRQVRHVHLGEAKPGGLYVEVAVYEAWQNGRVTGDSWAELFASSLYEVSRIFLTAAGDGLLDPILRTPLKPALETSDCLHASRTFGALAADAEEALRATPCAAAKTWRNILGTNDRGQVFPLPDGCSGSGVPVPAVAAVSANGPTRARGFALR

SEQ ID NO: 4162 - protein, 287 aa, Myxococcus xanthus
MLTVAQAFETFMNSLRLHDGEARDATRQEQYVFNAMRRQLRPTESFISGSYGRNTAIRPLHDIDLFLVLADDGRNPPEPEDALARVQWALRAEFHDKETRLQNRSVNINFTGTEIGFDVVPALYDPWEQGGYLIPDRRAGQWIRSNPRKHQEACDDANDVAKKKLKPWIKAIKRWNFRHDKPVPSFLLEVLACRGVTHSLGDKSYAEGLAQLFDYMCANILNQCPVPGSSGPTITSWIPQGRLVQAHQRLTQAVRVSKRALELEYSGYTVEALDLWRELLGTDFPVR

SEQ ID NO: 4163 - protein, 293 aa, Hyalangium minutum
MPTVAQSFEQFMQDLELREGENREAQRQERVVFDALRHHLSPRESILSGSYGRNTAIRPLHDIDLFLIFTTDSSGNGKVLQPQEFLERVAQALRKEFRGKQPRLQNRSVNIEFSGTGIGFDVVPAFEDLRQPGIYWIPDMRLGQWIRSNPRKHIAACDEANRKAMQRLKPLIKAIKRWNQLQGKPVPSFLLEVMAYEGIASFQPESHPSVYAQGMAHLFQFMSEHIRADWKDPAGLGPPVNAGVGEGHLQQGQQRLSGASRKAARALELERRVDMPGANELWRELLGTDYPVR

SEQ ID NO: 4164 - protein, 286 aa, Cystobacter ferrugineus
MKTVAWAFEQFMQSLELTDSESAEATRQQQEVFLRMQQQLRPQEAILSGSYGRNTAIRPLHDIDLFLVFPTDAVPPRHAPHDYLKQVLHALQAAYPHNQPRLQNRSVNIQFKGTGIGFDVVPAMEAPQQRNVYWIPDRSRDTWVCSNPRRHWEVCAQANERTNKKLKPLIKAIKRWNQLQNKPASSFHLEVMAYEGLATEPRDYASGLAGLFQFMSERIQRLTPEPAGLGPPVDNGLDTNRREQARQRLTGAASKAAHAVDRERVGDLSTAHQVWHELLGPDYRGW

SEQ ID NO: 4165 - protein, 280 aa, Myxococcus fulvus
MERFISSLELTEGQRSEVSRQHTLVREELSRRLAGCETSFLSGSYSRSTAIRPLHDVDIFTVVGRASSTSPETPDAALKRVRQALHDAWPNKELAILQQHSVHLGFTGSGIEFDVVPAYQHPSQDHFLIPERNSGQWIRTNPRVHKELSTAANERAGKKLKPLIKAVKHWKREHDVRVLGSFHLEVMGYEAFSRPPVGYLEGLETLFAFLANRVDQPVRDPAGFGKDVDERMTGGQRMAARNALQGAARTVRLALSERDARPEDAHRRLRELFGEAYRYR

SEQ ID NO: 4166 - protein, 287 aa, Myxococcus fulvus
MWSVGEALERFISSLELTEGQRSEVSRQHTLVREELSRRLAGCETSFLSGSYSRSTAIRPLHDVDIFTVVGRASSTSPETPDAALKRVRQALHDAWPNKELAILQQHSVHLGFTGSGIEFDVVPAYQHPSQDHFLIPERNSGQWIRTNPRVHKELSTAANERAGKKLKPLIKAVKHWKREHDVRVLGSFHLEVMGYEAFSRPPVGYLEGLETLFAFLANRVDQPVRDPAGFGKDVDERMTGGQRMAARNALQGAARTVRLALSERDARPEDAHRRLRELFGEAYRYR

SEQ ID NO: 4167 - protein, 287 aa, Myxococcus hansupus
MLSVGEALERFISSLELTEGQRDEVSRQHTLVREELSRRLAGCETSFLSGSYSRSTAIRPLHDIDIFTVVGRASSTPPETPDAALKRVRQALHEAWPNKELPILQQHSVHLEFTKSGIEFDVVPAYQHLSQELFLIPEGNTGRWIHTNPRIHKGLSTDANELAGKKFKPLIKAVKHWNRQHGSSPLRSFHLEVMGYEAFSQAPVGYLEGLHTLFAFMAGRVDRPVPDPAGLGGKVDARMTLGQRMAARNAFQGAARTVRLALSERDSNPERAHLRLRELFGETYRYR

SEQ ID NO: 4168 - protein, 287 aa, Myxococcus virescens
MWSVGEALERFISSLELTEGQRDEVSRQQTLVREALSRRLGGCETSFLSGSYSRSTAIRPLHDIDIFTVVGRASSTPPEPPDAALKRVRQALHETWPNKELPILQQHSVHLEFTTSGIEFDVVPAYQHPTQELFLIPEGNTGRWIRTNPRIHMDLSTAANERAGKKLKPLIKAVKHWNRQHGSSPLRSFHLEVMGYEAFSRAPVGYLEGLEALFAFMAGRVDRSTGDPAGLGGDVDARMTSGQRTAARNALQGAARTVQLALSERDARPEQAHQRLRALFGEMYWYR

SEQ ID NO: 4169 - protein, 287 aa, Archangium gephyra
MGSVGEALEKFIQSLELTEKQRNEVSRQHIMVREELRQRLKQKTDFLSGSYSRHTAIRPLHDIDIFVVLGDVSSTPSETPDSALKRVRLALKEPWQDKELPILQQHSVHLEFTKTGIEFDVVPAYQLSGHQEVYLIPERNTGRWIRSNPRRHLELSTRFNEQAGKKLKPLIKVVKHWNRQQRSSPLGSFHLEVMSYDAFPTPPAGYLEGLEALYAHLAQRVMRPCPDPAGLGADVDARMSSGQREAARNLFMGAARSLRLAREERDSRPGDAHARLRAFFGNDYRER

SEQ ID NO: 4170 - protein, 294 aa, Stigmatella aurantiaca
MWSVREALERFIQSLELTEGQQQEVVRQQTQVRECLVQRLQAKKVFLSGSYSRNTAIRPLHDIDLFVVLGAASLSSPLASASSTISMDAVFKQVQQALKQEWSNKGPRLQNHSVHIGFEESGIAFDVVPAYADPSSGQEVFLIPEKDTGQWIRTSPNIHKQRSTEANETAGKKLKPLLKAVKHWKRTHGSSPLRSFHLEVMSYSAFNTPPRDYLEGLERLFTHLSQRVQSPCPDPAHLGPAVDHLMSPTQREAAHQVLAGAARQARLAREESDSNPSSAHTRLINLFGEFYRKG

SEQ ID NO: 4171 - protein, 291 aa, Myxococcus stipitatus
MWTVRQAMQRLVEELEIPPVRHKAVTRQHEVVRAILRHALAPPEDFISGSYGRGTAVHPLNDVDLFVVLNPRRHPRGSKTTDETLKQIRQVFTEEWTERELPRLQNHSVRIAFSSKIDIDIVPAYQHEKMGYLIPERETGAWIHTNPKRHQAVAAEADAAAGHQLNRLIKLVKHWNRQQQSSPLRSFHLEAMCYQALPRPPTGTLLEQLGDVFEFLSKRVMHPCSDPAGLGGNVDAGFEKGQRESAQQLFLSASRTVRRANEVSEVSECDHSGPHAQLRKLFGDRYRTFEP

SEQ ID NO: 4172 - protein, 267 aa, Myxococcus stipitatus
MTRQHEVVRAILRHALAPPEDFISGSYGRGTAVHPLNDVDLFVVLNPRRHPRGSKTTDETLKQIRQVFTEEWTERELPRLQNHSVRIAFSSKIDIDIVPAYQHEKMGYLIPERETGAWIHTNPKRHQAVAAEADAAAGHQLNRLIKLVKHWNRQQQSSPLRSFHLEAMCYQALPRPPTGTLLEQLGDVFEFLSKRVMHPCSDPAGLGGNVDAGFEKGQRESAQQLFLSASRTVRRANEVSEVSECDHSGPHAQLRKLFGDRYRTFEP

SEQ ID NO: 4173 - protein, 296 aa, Myxococcus macrosporus
MRSVGHALQEAIESLELPPEQHRRVTARMQEVQQRLRAVFGPKTDFLSGSYGRGTSIRPLNDIDFFIVLGDVLMTAAPARPLLPSDALRELRDGIHKEIPRRNMPAIQLHSVRVEFEETPIQFDVIPAYACSNGPGYLIPERKKDQSEEKWVRTDPRRHQEACATANKRCEGRLHSLIKLVKHWNRKQHSPLKSFHLEVMSYSVQLPRLSRESGHLESLETLFAHLARGVMNRCTDPAELGDDVDVYLSPSQRSAASQLLDGAAREVRLAREEQDTHPARAHARMKKLFPDLYQGY

SEQ ID NO: 4174 - protein, 272 aa, Myxococcus macrosporus
MTARMQEVQQRLRAVFGPKTDFLSGSYGRGTSIRPLNDIDFFIVLGDVLMTAAPARPLLPSDALRELRDGIHKEIPRRNMPAIQLHSVRVEFEETPIQFDVIPAYACSNGPGYLIPERKKDQSEEKWVRTDPRRHQEACATANKRCEGRLHSLIKLVKHWNRKQHSPLKSFHLEVMSYSVQLPRLSRESGHLESLETLFAHLARGVMNRCTDPAELGDDVDVYLSPSQRSAASQLLDGAAREVRLAREEQDTHPARAHARMKKLFPDLYQGY

SEQ ID NO: 4175 - protein, 319 aa, Melittangium boletus
MQVRQAVHDFISALELTTAERTTASDQHKFLRDGLASRLEIEPDHYPFLTGSYARSTAIRPLKDIDLFCVLKRTPSLAPHISSPMDALKTVRRALEDQYPGKTADPQNRSVNISFSTTGIAYDVVPAFLDEGDNEIFWIPDLQAKTWIRSNPRIHERMSVDANEAAGKELKPLTKAVKHWNRRQMDGKRLRSFHIEVMIWDVLVAKPENRLDGLIQIFEGLASRVYLDTLDPAALGPPINQGMSDAEKTAAKTQLQQAAATLKEARELAQTGYTERAHYLLYGIFGDPYPEKGKEGRSVVTGVSASLPSAPDGHGSRFG

SEQ ID NO: 4176 - protein, 319 aa, Cystobacter fuscus
MQVRQAVHDFISALELTSAERTAASDQHKFLRDGLASRLEIEPDHYPFLTGSYARSTAIRPLKDIDLFCVLKRTPELDPAISSPMDALKTVRRALEDQYSGKTADPQNRSVNISFSTTGIAYDVVPAFLDKGNSEIFWIPDLQAKTWIRSNPRIHERLSVEANEAAGKELKPLTKAVKHWNRRQPDGARLRSFLIEVMIWDVLVAKPENRLDGLIQIFEGLASRVLLDTQDPAALGPYINQGMTDAEKTAAKTRLSQVAVTLKEAKELAQAGHTERAHDLLYGLFGDPYPEKGKEGRSTVIGVSASLPSAPDGHGSRFG

SEQ ID NO: 4177 - protein, 352 aa, Unknown
  Description of Unknown: uncultured bacterium sequence
MTVEEFFDNFLISQVNLNKLCDGECTGSEDGCDICLVTSKYKELVEKLQEKLKILPTEDEENEPSYFLTGSYRRHTMIRPPKDVDLFIVLDSGEYQDSELNDLITPKALIAKLKSVLKNIFVNDNGVEVEEQRHSVTVRYSETFSIDVIPAFEIDDSKAYKIPDIETGENGRYIVSNPKLHYEYINKINESTKVSEKKRFKKVVRLLKFVKRRKFNEDPIKIRSFHFELLAAKILGDVKIQSYAEGINNFFSRAGDYFDQASITDPANTDNMVDDYVDELDEQAKESIKTELAKLSQISNKAIELENSGNEESAITEWKKIFTDDDDETDKNFYVGGSTYVGNTPSKPWCNV

SEQ ID NO: 4178 - protein, 372 aa, Unknown
  Description of Unknown: candidate division WWE3 bacterium sequence
MTVEEAFDQLLVQRLNLTKLCKGECKGDNEKCDICKVSSAHKELAEALVKKLKIKSSDDEEKNPSTFLTGSYRRHTMNRPPKDIDFFIVLDSHSYKDEELDELITPKKLLDKLEKVLREIAEDLGLEVERQEHSVTVIYDDEFSVDIIPAFETDDGKDFQIACDTENTYMISNPKKHVELIDEVNEKSEKVTGKKRFKRLVRIIKSLKRDMFNDGDLKLRSFHLELAAADMFYDGKIYSYALGLEQFLRKIQVYLKNPGLSDPANKENFVDDYFLAKSQEARTKVINKFRELADMASGALEVEKEGNTEAAVRAWGKVVPSMGDFLEEKKVASELGAKINKGSVFAGSSSLGVNLSYGERKVVQSASWGESK

SEQ ID NO: 4179 - protein, 324 aa, Candidatus Roizmanbacteria bacterium
MTTEEYFKNLASKLELTEKERERISKKHNLLREKLREKLPVEDDFLTGSYSRDTMIRPGDDDKFDVDFFLAFNKDDYGNKELPELLKTVEEALDEIKAADEDIVAIDDQQKRSIGVIYNDNFQIDVVPAIQIEKDKLYKIFDKKTQNAVESNPKLHSKNLTDANESTEYGSIKRLVPIIKLFKAWRRAKCGYVKSFHLEMLIVKILKEQEIQSFSKGIIKFFANASVYLQSASLADPANENNIIDDYLDEDGTRDGVLSLVAVEKSIAEKAVEFENEGDNENAEKEWRKIFESEGDKNNGSEDPATKTGPVVINRAPAQPWCNV

SEQ ID NO: 4180 - protein, 336 aa, Candidatus Berkelbacteria bacterium
MTTEEFFKELASKLELTKNESDQISRKHNILREKLREKLQVEDDFLTGSYARNTMIRPKSDDKFDVDFFLAFSKKDYGESELPDLLNIVKNALEQIKDDDRDIKEILEQKRSIGVVYNSNFQIDVVPAVQIEKDKRYKIFDKNTLQAVESNPKLHGSNLTSANETTESGAVKRLVPIVKLLKSWKRDKCDYVKSFHLEILAVEILGGEEISSYSRGLTKFFTNAAQNLQSAGMKDPANEENIIDKYLDDDGKRDELLNLIADEKKVTEKAIEFENKGENDNAVNEWKKIFESGDDEKIARAIKSGNFYPGNDGITVKTNPESSNGKRIDSPRSWKS

SEQ ID NO: 4181 - protein, 320 aa, Candidatus Wolfebacteria bacterium
MTTEEFFKELAGKLELTKSESDQISRKHNILREKLREKLSVEDDFLTGSYARNTMIRPNGDDKFDVDFFLAFSKKDYGESELPDLLSMVKNALEQIKNGDTDIEEIQEQKRSIGVIYKDNFQIDVVPAVQIEKDKRYKIFDKNTLQAIESNPKLHGSNLTSANETSESGGIKRLVPIIKLLKFWKREKCDYVKSFHLEMLAVEILGGEEISSYSQGLVKFFANATQNLQSAGMKDPANQNNIIDEYLDSDGTRTKLLGLVNEEKEVAERAVKLEKEGNDDEAVKEWKKIIESSDDNKNSNYDYRSNGPTIIRNPSKPWAQ

SEQ ID NO: 4182 - protein, 377 aa, Candidatus Peribacteria bacterium
MSSTNVVTLDSIIDAYVANAVSLQKRCQTCSGTNEDCDICTILRHRPIRDQLESAGIYLKRYEKDEGNDYGYRNSFLTGSYARGTTAKRPPKDVDMFWVLDRSKYAAEKEPEPAALLNALAGVASSKTGTSIFGHAIINVEAQHRSIRIDFDDDFSIDIIPAFDASREGKELYEIPDSKLGRYIESNPKVHKENLNSAVSESDLPKLKNITKLARQWRGGAFEEHEKKPKSFHLETAIVEILRSSSLGTYVEMLQHCFDELPAYFNEPRIPDPACPDCPKDQWVDSYLDELSVEQKSLIVERINIAQGALAEAVKLEEQGKIVQAIRKLRGIFQDLPEQEPEALLRKTKESYTPSHATANTGGRTQPWSPRTPMVRE

SEQ ID NO: 4183 - protein, 376 aa, Candidatus Peribacteria bacterium
MSSTNVVTLDSIIDAYVANAVSLQKRCQTCSGTNEDCDICTILRHRPIRDQLESAGIYLKRYEKDEGNDYGYRNSFLTGSYARGTAKRPPKDVDMFWVLDRSKYAAEKEPEPAALLNALAGVASSKTGTSIFGHAIINVEAQHRSIRIDFDDDFSIDIIPAFDASREGKELYEIPDSKLGRYIESNPKVHKENLNSAVSESDLPKLKNITKLARQWRGGAFEEHEKKPKSFHLETAIVEILRSSSLGTYVEMLQHCFDELPAYFNEPRIPDPACPDCPKDQWVDSYLDELSVEQKSLIVERINIAQGALAEAVKLEEQGKIVQAIRKLRGIFQDLPEQEPEALLRKTKESYTPSHATANTGGRTQPWSPRTPMVRE

SEQ ID NO: 4184 - protein, 210 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDLKPVKPSFLIEVMALECL

SEQ ID NO: 4185 - protein, 213 aa, Delftia lacustris
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDLKPVKPSFLIEVMALECLYGG

SEQ ID NO: 4186 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKRGDLKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4187 - protein, 300 aa, Pseudomonas aeruginosa
MLSIDEAFRKFKSRLELNEREQKNASQRQNEVRDYLQTKFGIARSFLTGSYARYTKTKPLKDIDIFLVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDLKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4188 - protein, 300 aa, Acidovorax sp.
MLSIDEAFRKFKSRLELNEREQKNASQRQNEGRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4189 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYVNEWKGLVRMVKYWNNNPKHGDLKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4190 - protein, 300 aa, Unknown
  Description of Unknown: Proteobacteria sequence
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDLKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4191 - protein, 300 aa, Stenotrophomonas maltophilia
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVLAFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4192 - protein, 285 aa, Cupriavidus metallidurans
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDLKPVKPSFLIEVMALECLYGGWGGSFDREIQSFFATLADRVHDEWPDPAELGPAISNDMDAARKQRAQQLLFQASQDASIAIDHARRGRNIEA

SEQ ID NO: 4193 - protein, 216 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDLKPVKPSFLIEVMALECLYGGWGG

SEQ ID NO: 4194 - protein, 300 aa, Cupriavidus metallidurans
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDLKPVKPSFLIEVMALECLYGGWGGSFDREIQSFFATLADRVHDEWPDPAELGPAISNDMDAARKQRAQQLLFQASQDASIAIDHARRGRNIEALRAWRALFGPKFPLS

SEQ ID NO: 4195 - protein, 300 aa, Unknown
  Description of Unknown: Proteobacteria sequence
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4196 - protein, 300 aa, Pseudomonas aeruginosa
  MOD_RES (134)..(134): Any amino acid
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPXFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4197 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMEAARKQRAQQLLFQASQDASIAIDHARRGRNIEALRAWRALFGPKFPLS

SEQ ID NO: 4198 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYANEWKGLVRMVKYWNNNPKHGDLKPVKPSFLIEVMALECLYGGWGGSFDREIQSFFATLADRVHDEWPDPAGLGPAISNDMDAARKQRAQQLLFQASQDASLAIDHARRGRNIEALRAWRALFGPKFPLS

SEQ ID NO: 4199 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLNDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQQLFQASQDASIAIDHARRGRNIEALRAWRALFGPKFPLS

SEQ ID NO: 4200 - protein, 300 aa, Unknown
  Description of Unknown: Proteobacteria sequence
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDSASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLSQASQDASVAIDHARRGRNLEALRAWRALFGPKFPLS

SEQ ID NO: 4201 - protein, 300 aa, Unknown
  Description of Unknown: Pseudomonas sequence
MLSIDEAFRKFKSRLELNEREQKNASQRQNEVRDYLQTKFGIARSFLTGSYARYTKTKPLKDIDIFFVLKDSEKHYHGKAASAVLDDFHSALVEKYGSAAVRKQARSINVDFGVHIDAEDNTDYRVVSVDAVPAFDTGDQYEIPDSASGKWIKTDPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLSQASQDASVAIDHARRGRNLEALRAWRALFGPKFPLS

SEQ ID NO: 4202 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTNPEIHKDKATAAHQAYGNEWKGLVRMVKYWNNNPKHGDQKPVKPSFLIEVMALECLYGGWGGSFDREIQSFFATLADRVHDEWPDPAGLGPAISNDMDAARKQRAQQLLFQASQDASIAIDHARRGRNIEALRAWRALFGPKFPLS

SEQ ID NO: 4203 - protein, 300 aa, Achromobacter xylosoxidans
MLSIDEAFRKFKSRLELNEREQKNASQRQNEVRDYLQTKFGIARSFLTGSYARYTKTKPLKDIDIFFVLKDSEKHYHGKAASVVLDDFHAALVEKYGEAAVRKQARSINVDFGVHIDAEDNTDYRVVSVDAVPAFDTGDQYEIPDTASGKWIKTDPEIHKSKATAAHQAYGNEWKGLVRMVKYWNNNPKHGDQKPVKPSFLIEVMALECLYGGWGGSFDREIQSFFATLADRIHDEWPDPAGLGPAISNDMDAARKQRAQQLLFQASQDASTAIDHTRRGRNIEALRAWRALFGPKFPLS

SEQ ID NO: 4204 - protein, 210 aa, Delftia lacustris
MLSIDEAFRKFKSRLELNEREQKNASQRQNEVRDYLQTKFGIARSFLTGSYARYTKTKPLKDIDIFFVLKDSEKHYHGKAASVVLDDFHSALVEKYGSAAVRKQARSINVDFGVHIDAEDNTDYRVVSVDAVPAFDTGDQYEIPDTASGKWIKTDPEIHKDKATAAHQAYGNEWKGLVRMVKYWNNNPKHGDLKPVKPSFRGLLVFSAIS

SEQ ID NO: 4205 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYHGKAASVVLDDFHAALVEKYGAAAVRKQARSINVDFGVHIDAEDNTDYRVVSVDAVPAFDTGSEYEIPDSASGKWIKTDPEIHKEQATAAHQAYGNEWKGLVRMVKYWNNNPKHGTDKPVKPSFLIEVMALECLYGGWGGSFDREIQSFFATLADRVHDEWLDPAGLGPAISNDMDAARKQRAQELLAQASRDAAVAIDHSRRGRNLEALRAWRTLFGPKFPLS

SEQ ID NO: 4206 - protein, 300 aa, Pseudomonas putida
MLSIDEAFRKFKSRLELNEREQKNASQRQNEVRDYLQTKFGIARSFLTGSYARYTKTKPLKDIDIFFVLKDSEKHYHGKAASVVLDDFHAALVEKYGAAAVRKQARSINVDFGVHIDAEDNTDYRVVSVDAVPAFDTGSEYEIPDSASGKWIKTDPEIHKEKATAAHQAYGNEWKGLVRMVKYWNNNPKHGTDKPVKPSFLIEVMALECLYGGWGGSFDREIQSFFATLADRVHDEWPDPAGLGPAISNDMDAARKQRAQELLAQASRDAAVAIDHSRRGRNLEALRAWRTLFGPKFPLS

SEQ ID NO: 4207 - protein, 300 aa, Stenotrophomonas sp.
MLSIDEAFRKFKSRLELNEREQKNASQRQNEVRDYLQTKFGIARSFLTGSYARYTKTKPLKDIDIFFVLTDSEKHYHGKAASVVLDDFHAALVEKYGAAAVRKQARSINVDFGVHIDAEDNTDYRVVSVDAVPAFDTGSEYEIPDSASGKWIKTDPEIHKEKATAAHQAYGNEWKGLVRMVKYWNNNPKHGTDKPVKPSFLIEVMALECLYGGWGGSFDREIQSFFATLADRVHDEWPDPAGLGPAISNDMDAARKQRAQELLAQASRDAAVAIDHSRRGRNLEALRAWRTLFGPKFPLS

SEQ ID NO: 4208 - protein, 300 aa, Pseudomonas aeruginosa
MLSIDEAFRKFKSRLELNEREQKNASQRQNEVRDYLQTKFGIARSFLTGSYARYTKTKPLKDIDIFFVLKDSEKHYRGKAASVVLDDFHAALVEKYGAAAVRKQARSINVDFGVHIDAEDNTDYRVVSVDAVPAFDTGSEYEIPDSASGKWIKTDPEIHKEKATAAHQAYGNEWKGLVRMVKYWNNNPKHGTEKPVKPSFLIEVMALECLYGGWGGSFDREIQSFFATLADRVHDEWPDPAGLGPAISNDMDAARKQRAQELLAQASRDAAIAIDHSRRGRNLEALRAWRTLFGPKFPLS

SEQ ID NO: 4209 - protein, 300 aa, Ralstonia solanacearum
MLSIDEAFRKFKSRLELNEREQQNASQRQNEVRDYLQTKFGIARSFLTGSYARHTKTKPLKDIDIFFVLADSEKHYHGKPATVVLDAFHAALVEKYGEAAVRKQARSICVDFGVYIDAEDNTDYRVVSVDAVPAYDNGTEYEIPDSGSGKWIKTDPEIHKEKATAAHQAYSNEWKGLVRMVKYWNNNPKHGDQKPVKPSFLIEVMALECLHGGWGGSFEREIQTLFATLADRIFDEWPDPAGLGPAISDDMDAERKARAQQLLNQASRDASLAIDHARKGRNGEALQAWRAIFGAKFPLS

SEQ ID NO: 4210 - protein, 223 aa, Pseudomonas sp.
MLTTDEAFRKFKSRLELNDREQKNASQRQNEVRDYLGTKFGIARSFLTGSYARHTKTKPLKDIDIFFVLKESEEHYHGKAASVVLDDFHAALAEKYGKDSVRKQARSVNVDFGVVIDAEDNTDYRVVSIDAVPAFDTGSEYEIPDSASGKWIKTDPEIHASKAVAAHQAYGSEWKGLVRMVKYWNNNPKHGSDKPVKPSFLIEVMALECLYGGWGGSFDRESQ

SEQ ID NO: 4211 - protein, 240 aa, Pseudomonas sp.
MLTTDEAFRKFKSRLELNDREQKNASQRQNEVRDYLGTKFGIARSFLTGSYARHTKTKPLKDIDIFFVLKESEEHYHGKAASVVLDDFHAALAEKYGKDSVRKQARSVNVDFGVVIDAEDNTDYRVVSIDAVPAFDTGSEYEIPDSASGKWIKTDPEIHASKAVAAHQAYGSEWKGLVRMVKYWNNNPKHGSDKPVKPSFLIEVMALECLYGGWGGSFDRESQRTDGCRGFRSAFHAHVA

SEQ ID NO: 4212 - protein, 300 aa, Pseudomonas aeruginosa
MLTTDEAFRKFKSRLELNDREQKNASQRQNEVRDYLETKFGIARSFLTGSYARHTKTKPLKDIDIFFVLKESEEHYHGKAASVVLDDFHAALAEKYGKDSVRKQARSVNVDFGVVIDAEDNTDYRVISIDAVPAFDTGSEYEIPDSASGKWIKTDPEIHASKAVAAHQAYGNEWKGLVRMVKYWNNNPKHGSDKPVKPSFLIEVMALECLYGGWGGSFDREIQAFFSTLADRILDTWPDPAGLGPAISNDMDDARKRRAQELLRAASKEASIAIDYARRGRNGEALRAWRTLFGPKFPLS

SEQ ID NO: 4213 - protein, 300 aa, Burkholderia stabilis
MLTIDEAFRKFKSRLELNDREQKNASQRQTEVREYLETKFGIQRSFLTGSYARHTKTKPLKDIDIFFVLKDSEKHYHTKGASVVLDDFYTALVEKYGADSVRKQARSVNVDFGVYIDAEDNTDYRVVSVDAVPAFDTGTEYEIPDSASGKWIKTDPEIHKEKATAAHQAYGNEWKGLVRMVKYWNNNPKHGDQKPVKPSFLIEVMALECLHGGWGGSFDREIQSFFATLADRIHDVWPDPAGLGPAISNDMDTVRKQRAQQFLTQASRDATIAIDHARRGRNGEALRAWRAIFGQKFPLS

SEQ ID NO: 4214 - protein, 299 aa, Cystobacter ferrugineus
MLSIEEAFRKFKSRLELNDKEQQNASSRHTEVREYLETKFDITRSFLTGSYARYTKTKPLKDIDIFMVLADEKKHYRSSSPSIVLEDFRKALASKYGKKSVRKQARSINVNFGVVIDAEDNTDYRVVSIDAVPAIDTGHEYEIPDSDSDSWIKTDPEIHKEKATAAHQAYSNEWKGLVRMVKYWNNNPGHGEKPIKPSFLIEVMALECLHGGWGGRFDYELQSFFSTLADRIFDEWPDPAALGPPISDGMDLGQKQRAAGLLRTASRQASLAINHVRQGRNGEALRVWRELFGPKFPLT

SEQ ID NO: 4215 - protein, 298 aa, Sphingomonadales bacterium
MLTVDEAFRKFKSRLELNDREQANASARQKEVRDYLDTKFKIDRSFLTGSYARWTKTKPLKDVDIFFVLKSSENHYLSKAPSIVLTDFHNALVEKYGDKAKKQNRSINVDFGVQADADDNTDYRVISVDVVPAFDKDSDFEIPDNELGKWIKTNPQIHAEKATAAHQAYSNEWKGLVRMVKYWNNNPKHGEKPVKPSFLIEVMALQCLYGGWGGSFDREMQGFFATLADRIFDEWPDPAGLGPAISNGMDSARKTRARDLLRAAEREATLAIDHVRRGRNGEALRAWRELFGPKFPLS

SEQ ID NO: 4216 - protein, 298 aa, Rhizobiales bacterium
MLTVDEAFRKFKSRLELNDREQANASARQKEVRDYLDTKFKIDRSFLTGSYARWTKTKPLKDVDIFFVLKSSEVHYRSKAPSVVLTDFHNALVEKYGDKTKKQNRSINVDFGVKADADDNTDYRVISVDVVPAFDKDDDFEIPDNELGKWIKTNPQTHAAEATAAHQAYSNEWKGLVRMVKYWNNNPKHGEKPVKPSFLIEVMALQCLHGGWGGSFDREIQGFFATLAARIFDEWPDPAGLGPAISNGMDTARKTRARDLLRAAEREATLAIDHVRHGRNGEALRAWRELFGPKFPLS

SEQ ID NO: 4217 - protein, 298 aa, Hoeflea sp.
MLTVDEAFRKFKSRLELNDREQANASARQKEVRDYLDTKFKIDRSFLTGSYARWTKTKPLKDVDIFFVLKSSEDHYRSKSPSVVLTDFHNALAEKYGDKAKKQNRSINVDFGVKADTDDNTDYRVISVDIVPAFDKDDDFEIPDNELGKWIGTNPQTHAAEATAAHQAYSNEWKGLVRMVKYWNNKTKHGEKPVKPSFLIEVMALQCLHGGWGGSFDREIQGFFATLAARIFDEWPDPAGLGPAISNGMDTARKTRARDLLRAAEREATLAIDHVRRGRNGEALRAWRELFGPKFPLS

SEQ ID NO: 4218 - protein, 298 aa, Rhodopseudomonas palustris
MLTIDEAFRKFKSRLELNDREQANASARQKEVRDYLDTKFKIDRSFLTGSYARWTKTKPLKDVDIFFVLKSSEDHYRSKGPSVVLTDFHNALVEKYGDKAKKQNRSINVDFGVKADAEDNTDYRVISVDVVPAFDKDNDFEIPDNELGKWIGTNPKTHAAEATAAHQAYSSEWKGLVRMLKYWNNNPKHGEKPVKPSFLIEVMAMQCLYGGWGGRFDREIQGVFATLSARIFDEWPDPAGLGPPISDGMDTARKTRARELLRAAEREATLAIDHVRRGRNGEALRAWRELFGPKFPLS

SEQ ID NO: 4219 - protein, 298 aa, Insolitispirillum peregrinum
MLTIDDAFRKFKSRLELNDKEQANASARQKEVRDYLDTKFKIDRSFLTGSYARWTKTKPLKDVDIFFVLKASEDHYRARAPSVVLADFYNALVEKYGDRVKKQNRSINVDFGVKADANDNTDYRVISVDVVPAFDKDDDFEIPDNELGEWIKTNPKTHAAEATAAHQAYSNEWKGLVRMVKYWNNNPKHGEKPVKPSFLIEVMALQCLHGGWGGSFDREIQGLFATLAARIFDEWPDPAGLGPAISNGMDAERKTRARDLLRAAEREATLAIDHVRRGRNGEALRAWRELFGPKFPLS

SEQ ID NO: 4220 - protein, 298 aa, Hartmannibacter diazotrophicus
MLTIDEAFRKFKSRLELNDREQANASARQKEVRDYLDTKFKIDRSFLTGSYARWTKTKPLKDVDIFFVLKSSEDHYRSKAPSVVLTDFHNALVEKYGDKARKQNRSINVDFGVKADAEDNTDYRVISVDVVPAFDKDDDFEIPDNELGKWIGTNPQTHAAEATAAHQAYSNEWKGLVRMVKYWNNNPKHGEKPVKPSFLIEVMAMQCLYGGWGGSFDREIQGFFATLAARIFDEWPDPAGLGPPISNGMDTARKTRARDLLLAAEREATLAIDHVRRGRNGQALRAWRELFGPKFPLS

SEQ ID NO: 4221 - protein, 298 aa, Unknown
  Description of Unknown: Roseomonas sequence
MLTIDEAFRKFKSRLELNDREQANASARQKEVRDYLDTKFKIDRSFLTGSYARWTKTKPLKDVDIFFVLKPSEDHYRSKAPSVVLTDFHNALVEKYGDKAKKQNRSINVDFGVRADAEDNTDYRVISVDVVPAFDKDENFEIPDNEIGKWIGTNPQTHAAEATTAHQAYSNEWKGLVRMLKYWNNNPKHGEKPVKPSFLIEVMAMQCLYGGWGGSFDREIQGFFATLAARVFDEWPDPAGLGPPISNSMDTARKTRARDLLRAAEREATVAIDHVRHGRNGEALRAWRELFGPKFPLS

SEQ ID NO: 4222 - protein, 298 aa, Novosphingobium lentum
MLTVDEAFRKFKSRLELNDKEQANASARQKEVRDYLDTKFKIDRSFLTGSYARWTKTKPLKDVDIFFVLKSSEDHYQAKAPSVVLTDFHNALAEKYGDKAKKQNRSINVDFGVKADVEDNTDYRVISVDVVPAFDQDGDFEIPDNELGKWIKTNPQTHAAEATAAHQAYSKEWKGLVRMAKYWNNNPKHGEKPVKPSFLIEVMAMQCLYGGWGGSFDREIQGFFATLADRIHDEWPDPAGLGPAISNGMDDVRRGRARDLLRAAEREATLAIDHARRGRNGEALRAWRDLFGPKFPLS

SEQ ID NO: 4223 - protein, 298 aa, Afipia sp.
MLTIDEAFRKFKSRLELNDREQANASARQTEVRDYLDTKFKIDRSFLTGSYARWTKTKPLKDVDIFFVLKTSEDHYRSKAPSIVLTDFHNALVEKYGDKAKKQNRSINVDFGVKADAEDNTDYRVISVDVVPAFDKDDDFEIPDNEVGKWIETNPKVHAEKATAAHQAYSSEWKGLVRMVKYWNNNPKHGEKPVKPSFLLEVMALQCLHGGWGGSFDREMQAFFATLADRIFDEWPDPAGLGPAVSNGMDSARKTRARDLLRAAEREATLAIDHVRRGRNGEALRVWRELFGPKFPLS

SEQ ID NO: 4224 - protein, 298 aa, Phyllobacterium sp.
MLTIDEAFRKFKTRLELNDKEQKNASARQTEVRDYLDTKFKIDRSFLTGSYARWTKTKPLKDVDIFFVLKSSEDHYRSKAPSVVLTDFHNALVAKYGDKTKKQNRSINVDFGVKADADDNTDYRVISVDVVPAFDKDGDFEIPDNDLGRWIKTNPKIHAEKATAAHQAYSSEWKGLVRMVKYWNNNPRHGEKPIKPSFLIEVMALQCLYGGWGGSFDREMQSLFATLADRILDEWPDPAGLGPPISNGMDTARKNRARELLLAAGREATLAIDHVRRGRNGEALRAWRELFGPKFPLS

SEQ ID NO: 4225 - protein, 298 aa, Parvibaculum lavamentivorans
MLTVDEAFRKFKSRLELNDKEQKNASARQTEVRDYIDTKFKIDRSFLTGSYARWTKTKPLKDVDIFFVLKSSEDHYRSKAPSTVLTDFHDALVEKYGDNARKQNRSINIDFGVTADTDDNTDYRVISVDVVPAFDVGDDFEIPDDELKKWIKTNPQTHAAKATAAHQAYSSEWKGLVRMVKYWNNHPKHGEKPVKPSFLLEVMALQCLHGGWGGSFDREVQGFFATLADRMLDEWPDPAGLGPAISNGMDTARRARACDLLRAAERQATLAIAHTRCGRNGEALRAWRDLFGPKFPLS

SEQ ID NO: 4226 - protein, 299 aa, Myxococcus fulvus
MLTVEDAFKKFKSRLELNDKEQANASNRQQEVRDYLDSKFKIERSFLTGSYARWTKTKPLKDVDIFFVLKSAEAHYRTKAPSVVLTDFHAALVAEFGSDKAKKQNRSININFGVKADENDNTDYRLISVDVVPAFEKAENYEIPDNELGKWILSNPEIHAAKAVEAHQAYSSEWKGLVRMVKYWNNNPAHGDKPVKPSFLIEVMALQCLHGGWGGSFAREIQALFATLADRIHEQWPDPAGLGPPISNGMDARQKDRAAQLLRAASRSAAIAIDHVRNGRNGEALKTWRALFGPKFPLS

SEQ ID NO: 4227 - protein, 299 aa, Streptomyces purpurogeneiscleroticus
MLSVDEAFRKFRSRLELNEKEQANASARQKEVREFIETKFKIDRSFLTGSYRRWTKTKPLKDVDIFFVLKASEQHYRDKKPAVILDDFHAALVDKYGSDKAKRQNRSINVDFGVRPNEDDNTDYRVMSVDIVPAFADGDDYEIPDDTLGKWIKTNPEIHAAKAVEAHQAFASEWKGMVRMVKYWNNNARHGERPVKPSFLLEVMCLQCLHAPWCGSFEREFQGLFSTLADRIHDTWADPAGLGPPISDGMDTARKARAQQLLRQASRNIDMILNLSRRGQNGEALKAWRTFFGTKFPLS

SEQ ID NO: 4228 - protein, 299 aa, Methylobacterium sp.
MLNVDEAFRKFKSRLELNDKEQANASARQKEVREYIETKFKIDRSFLTGSYARWTKTKPLKDVDIFFVLKPSENHYRNKAPAVVLNDFHSALVDKYGSSNAKRQNRSINVDFGVKADADDNTDYRVISLDVVPAFDKDDNFEIPDDTLGKWIGTNPQVHAKKAVEAHQAFACEWKGLVRMIKYWNNNPRHGEKPVKPSFLLEVMSLQCLHAPWGGNFDREIQGLFSTLADRIHETWPDPAGLGPPISDGMDTARKDRAARLLREASRDASSAIHLTRRGQNGEALKAWRALFGPKFPLS

SEQ ID NO: 4229 - protein, 299 aa, Methylobacterium zatmanii
MLNVDDAFRKFKSRLELNNKEQVNAQDRHKEVREYIESKFKIDRSFLTGSYARWTKTKPLKDIDIFFVMKPSENHYREKGPTIILDDFHSALVEKYGKDNTKRQNRSINVDFGVRADESDKTDYKVISIDVVPAFDKGTDYEIPDDTLGKWIGTNPQTHAQKAVEAQQAFSSEWKGLVRMVKYWNNNPRHGEKPVKPSFLIEVMCLQCLHAPWGGAFDREVQALFSTLADRIYETWADPAGLGPPISDGMDSAGKSRAEKLLREASRDASLAIDLKRRGKNGEALKAWRTLFGPRFPLS

SEQ ID NO: 4230 - protein, 298 aa, Stenotrophomonas maltophilia
MISIEDAFRKFKHRLELNDREQANAIARHQEVRDQIRDKFKVDTDFLTGSYARWTKTKPLKDIDIFFVLKNSESTYLSKSPSVVLDDFFSALKEKYGDRVKRQRRSLNVSFGVSADGEDNTDYRVMSVDVVPAFPSGDNYAIPDEALGEWIDTNPKIHADKATAAHQAYSSEWKGIVRMLKYWNNNPTHGEKPIKPSFLIEVMCLQALHGGWGGSFEREIQGVFATLADRIFDTFDDPAGLGPPISDEMDQARKQRAQSLLRAAEREAAVAIDHARRGRQGEALRAWRSLFGVKFPLS

SEQ ID NO: 4231 - protein, 299 aa, Arenimonas metalli
MITLDDAFRKFRSRLELNEREQKNASARHTEVREHVRSKFKIECDFLTGSYARYTKTKPLKDVDIFFVLQGSERGYRERPPSEIIDAFHKALVEKYGDKKVKKQARSICVDFGVDVDEDDNTNYRILSVDVVPAFRAAVDYEIPDTTSGKWIKTNPEVHADKATAAHKNYSNEWKGLVRMLKYWNNNPKHGEKPVKPSFLLEVMALDCLHGKWGGQFDREFQGLFATLANRIHESWPDPAGLGPPVSDGMDAARKNRAKSLLEAAGREATLAIHLARQGKHGEALDAWRKLFGPKFPKS

SEQ ID NO: 4232 - protein, 299 aa, Thauera linaloolentis
MLTVDEAFRKFKSRLELNDREQKNASARHTEVRGFVRTKFAIDRDFLTGSYARYTKTKPLKDIDIFFVMKQAERHYREKAAGVVLDKYKEVLVEKYGEKAVRRQSRSINIDFGVDVKEEDKTDYKILSVDVVPAFDSGDDYEIPDGDTGKWIKTNPQKHAEKAVDAHRAYGSEWKGLVRMAKYWNNNKKHGEKPVKPSFLIEVIALDCLYGGWSGQFDREMQAFFATLAQRIGETWADPAGLGPPISASMDATRIANARRTLEEAARQAGIAINHVRQGRNGEALRTWRELFGPMFPLS

SEQ ID NO: 4233 - protein, 299 aa, Thauera terpenica
MLTVDEAFRKFKSRLELNDREQKNASARHTEVREFVRTKFAIDRDFLTGSYARYTKTKPLKDIDIFFVMKQAERHYRDEAAGVVLDKYKEVLVEKYGEKAVRRQSRSINIDFGVDVKEEDKTDYKILSVDVVPAFDSGDDYEIPDGDTGKWIKTNPQKHAEKAVNAHRAYGSEWKGLVRMAKYWNNNKKHGEKPVKPSFLIEVMALDCLYGGWSGQFDREMQAFFATLAQRIGETWADPTGLGPPISASMDATRIANARRALEEAAHQAGIAINHVRQGRNGEALRTWRELFGPMFPLS

SEQ ID NO: 4234 - protein, 299 aa, Unknown
  Description of Unknown: Pelomonas sequence
MLTIDEAFRKFKSRLELNAKEQKNASERHTEVRNFIRSKFAIDRDFLTGSYARYTKTKPLKDIDIFFVMAETEKHYRGKSAGVVLDDYQAALLEEYGEKAVRRQSRSINVDFGVDVKEEDKTDYKILSVDVVPAFPCGNDYEIPDDDSGKWIKTNPETHAEKATKAHQNYGNEWKGLVRMVKYWNNNKKHGEKPIKPSFLIEVMALQCLYGGWGGQFDREIQSFFATMATRIGEVWADPAGLGPPISNSMNAARVTRAQQALRQAASEADRAINLVRQGRTGDALKAWRDLFGPMFPLS

SEQ ID NO: 4235 - protein, 299 aa, Methyloversatilis universalis
MLTIDEAFRKFKSRLELNDREQKNASDRHTEVREFIRTKFTIDRDFLTGSYKRHTKTKPLKDIDIFFVMKNGEKGYRSKSAAVVLDDYEVALKEKYGGKAITRQSRSINVDFGVVVDSEDNTDYRVLSVDVVPAFASGDDYEIPDDDTGKWIKTNPEIHARKATEAHQAYSNEWKGLVRMVKYWNNNPKHGEKPIKPSFLIEVMALQCMHGGWGGQFDREIQSFFATLADRIGDTWPDPAGLGPPISDAMDAARVARAKNILTEALRQANEAIHHVRSGRNGEALRVWRELFGKKFPLS

SEQ ID NO: 4236 - protein, 300 aa, Acidovorax sp.
MTLTVNEAFRKFKSRLELNQKEQDNASAKHTEVRDYLHTKFAIEGDFLTGSYKRHTKTKPLKDIDIFFPMKQTERHYHDKAAGVVLDDYKAALVAKYGEKAVRRQSRSINVDFGVEIKDEDKTDYKVLSIDVVPAFACGDNYEIPDGDTGKWIKTNPKIHAQKAVDAHQAYSSEWKGLVRMVKYWNNNPKHGEKPVKPSFLIEVMALECLHGGWGGQFDREIQSFFATLADRIGDTWEDPAKLGPPISGSMDAARVERAKKLLTAAARAADHAIHLVRQGKNGEALRAWRDLFGPMFPLT

SEQ ID NO: 4237 - protein, 300 aa, Acidovorax sp.
MTLTVNEAFRKFKSRLELNQKEQDNASAKHTEVRDYLHTKFAIEGDFLTGSYKRHTKTKPLKDIDIFFPMKQSERHYRDKDPGVVLDDYTAVMVEKYGEKAVRRQSRSINVDFGIEIKDEDKTDYKVLSIDVVPAFTCDENYEIPDGDTSKWIKTNPKIHAQKAVDAHQAYSSEWKGLVRMVKYWNNNPKHGEKPVKPSFLIEVMAHECLHGGWGGQFDREIQSFFATLADRIGDTWEDPAKLGPPISGSMDAARVERAKKLLTAAAREADQAIHLVRQGKNGEALRAWRDLFGPMFPLS

SEQ ID NO: 4238 - protein, 317 aa, Candidatus Burkholderia verschuerenii
MLSTNDAFKKFKHRLELNTREQDNASARQNEVRDFLKTKFQIERSFLTGSYARYTKTKPLKDIDIFFVLGKDEKHYHDKPASAVLDAFYDALVEKYGTSAMRKQDRSINVDFGVKVGEEDKTDYRILSIDVVPAFDVGTEYEIPDTASGKWIKTDPEIHAQKAVDAYRAYSNEWKGLVRMVKYWNNNPKHGDQKPVKPSFLIEVMALECLDGGWGGSYEREMQGFFATLASRIKEEWPDPADLGPPISNGMDLERKERAERLLKEAAREVTLAINLTRQGKNTDGFRHLPDLVGGDQPFNFNVGGAMWNFSAYLSRR

SEQ ID NO: 4239 - protein, 300 aa, Burkholderia sp.
MLSTNDAFKKFKHRLELNSREQDNASARQNEVRDFLKTKFQIERSFLTGSYARYTKTKPLKDIDIFFVLGKDEKHYHDKAASVVLDAFYDALIEKYGTSAVRKQDRSINVDFGVKVGEEDKTDYRILSIDVVPAFDIGTEYEIPDTASGKWIKTDPEIHAQKAVDAHREYSNEWKGLVRMVKYWNNNPKHGEQKPVKPSFLIEVMALECLDGGWGGSYEREMQGFFATLADRVKDEWPDPAGLGPPISNGMDLERKERAERLLKEAAREVTLAINLTRQGKNTEALRAWRSLFGPMFPLS

SEQ ID NO: 4240 - protein, 300 aa, Herbaspirillum rubrisubalbicans
MLTTNEAFKKFKHRLELNQKEQDNASARQNEVRDYLKTKFDIERSFLTGSYARYTKTKPLKDIDIFFVLGKDEKHYHSKSASTILDAFYDALVEKYGKSAVRKQDRSINVDFGVSVDDEDRTNYKILSIDVVPAFDVGKEYEIPDTASGKWIKTDPEIHADKAVKAHQAYSNEWKGLVRMVKYWNNNPKHGADKPVKPSFLIEVMALEVLYGGWGGSYEREMQGLFATLADRIKDEWKDPAGLGPAISNGMDAARKDRAQRLLNEAAREATLAINLARQGKNGEALKAWRTLFGPMFPLS

SEQ ID NO: 4241 - protein, 300 aa, Komagataeibacter rhaeticus
MITIDEAFRKFKSRLELNEKEQQNASDRQNEVRDYLVTKFAIARSFLTGSYKRHTKTKPLKDIDIFFVLKDSETGKYRDKAPSVVIGDFYDALVEKYGSSAVRKQGRSVNVDFGVVVDSDDNTDYRVLSVDVVPAFASASDYEIPDTDKGEWIKTNPETHAAKATTAHQAYSNEWKGLVRMVKYWNNLPLHGEKPVKPSFLIEVMALECLYGGWQGNFAYEFQALFATLADRIFDTWPDPAGLGPPVSDGMDNARKERARTLLMTASREASVAINLARQGKNGEALKAWRALFGPKFPLS

SEQ ID NO: 4242 - protein, 301 aa, Agrobacterium tumefaciens
MLTTDDAFRKFKSRLELNDREQENASKRQNEVRDYLDTKFAIANSFLTGSYKRHTKSKPLKDIDIFFVLKESERSKYRDKAPSVVLDDFHKALVEKYGEKAVRKQGRSVNVDFGVAVDAEDNTDYRILSVDVVPAFPSGDDYEIPDTDKGEWIKTNPKIHAQKAIDAHQAFSNEWKGLVRMVKYWNNNPRHGADKPVKPSFLIEVMALECLYGGWQGRFDYEIEGLFSTLADRIFDTWADPARLGPPISDGMDGTRKQRARNLLMAAGRDARSAINLAKQGRNGDALKAWRALFGPKFPLS

SEQ ID NO: 4243 - protein, 300 aa, Rhizobium leguminosarum
MLTTDEAFRKFKSRLELNDREQQNASTRQNEVRDYLVTKFAIANSFLTGSYKRHTKTKPLKDIDIFFVLKDSEKDYKDKAPSVVIGDFHKALVDKYGEKAVRKQARSVNVDFGVVVDAEDNTEYRILSVDVVPAFASGDDYEIPDTDNGKWIKTNPKIHADKATAAHQAFSNEWKGLVRMVKYWNNNPRHGSDKPVKPSFLLEVMALQCLYGGWQGRFDYEIEGLFSTLADRIFDTWADPAGLGPPISDGMDATRKQRARDLLLAASREARSAINLAKQGRNGDALKAWRTLFGPKFPLS

SEQ ID NO: 4244 - protein, 300 aa, Agrobacterium tumefaciens
MLTTDEAFRKFKSRLELNDREQQNASTRQNEVRDYLVTKFAIANSFLTGSYKRHTKTKPLKDIDIFFVLKDSEKDYKDKAPSVVIDDFHKALVDKYGEKAVRKQARSVNVDFGVIVDAEDNTDYRILSVDVVPAFASSDDYEIPDTDNGKWIKTNPKIHADKATAAHQAFSNEWKGLVRMIKYWNNNTRHGSDKPVKPSFLIEVMALQCLYGGWQGRFDYEIEGLFSTLADRIFDAWADPAGLGPPISDGMDATRKQRARDLLLAASRDARSAINLAKQGRNGDALKAWRTLFGPKFPLS

SEQ ID NO: 4245 - protein, 300 aa, Rhizobium leguminosarum
MLTTDEAFRKFKSRLELNEREQQNASNRQNEVRDYLDTKFAIANSFLTGSYKRHTKTKPLKDIDIFVVLKDSEKAYRDKTPSVVIDDFYKALVEKYGEKAVRKQGRSVNVDFGVVVDAEDNTDYRILSVDVVPSFPSGDDYEIPDTDKGKWIKTNPKIHAQKATDAHQAFSSEWKGLVRMVKYWNNNPRHGADKPVKPSFMIEVMALECLYGGWQGRFDYEIEGLFSTLADRVFDTWVDPAGLGPPISDGMDATRKQRARDLLVAASRDARNAINLAKQGCNGEALKAWRALFGPKFPLT

SEQ ID NO: 4246 - protein, 300 aa, Mesorhizobium sp.
MLRVDEAFRKFKSRLELNDREQANASARQNEVRDYLDTKFKIETSFLTGSYKRHTKTKPLKDIDIFFVLKDAERHYRDKAPSVVIQDFCDALVAKYGKDAVRKQSRSVNVDFGVFVDAEDNTDYRILSVDVVPAFAKGQDYEIPDTDSGTWIKTNPKIHAEKATAAHQAFSNEWKGLVRMVKYWNNNPKHGADKPVKPSFLIEVMALECLHGGWQGRFDREIQALFATLADRIFDTWPDPAGLGPAISNGMDNARKQRARELLTAASRDASLAINHERQGRHGDALAAWRALFGKKFPLS

SEQ ID NO: 4247 - protein, 300 aa, Methylobacterium sp.
MLTVDEAFRKFKSRLELNDKEQANASARQNEVREYLDTKFSIDNSFLTGSYRRHTKTKPLKDIDIFFVLKESERHYRDKPPSVVIKDFCDALVDKYGKDAVRKQSRSVNVDFGVVVDAEDNTDYRVLSVDVVPAFAKGTDYEIPDTDSGVWIKTNPKIHADKATAAHQSFSSEWKGLVRMVKYWNNNPKHGADKPVKPSFLIEVMALECLYGGWQGRFDIEIQALFATLADRIFDTWPDPAGLGPAISNGMDNARKQRARDLLMAASREASLAINHARQGRNGEGLKAWRALFGPKFPLS

SEQ ID NO: 4248 - protein, 300 aa, Mesorhizobium sp.
MLTLDEAFRKFKSRLELNDKEQKNASARQQEVRNYLDTKFSIANSFLTGSYARYTKTKPLKDIDIFFVLNDSERHYRSKAPSAVINAFYDALVEKYGEKAVRKQSRSVNVDFGVHVDAEDNTDYRILSVDVVPAFPKGDDYEIPDTDTGQWIKTNPKIHAEKATAAHQAFSNEWKGLVRMVKYWNNNPRHGAEKPIKPSFLIEVMALECLYGGWQGQFDRELQSLFSTLADRIFDTWPDPAGLGPAISNGMDQARKLRARDLLMQASRDATAAINLARQGRNGDVLKAWRALFGPKFPLT

SEQ ID NO: 4249 - protein, 299 aa, Desulfovibrio africanus
MLTVEEAFRKFKSRLELNAKEQKNASARHTEVREYLATKFKVDRSFLTGSYARHTKTKPLKDIDIFFILKVDEKHYRSKAPSMVIGDFYDALVKKYGKDAVRKQSRSVNVDFGVVVDVEDNTDYRVVSVDVVPAFSAGDDYEIPDDPTGKWIKTNPEIHASKATTAHQAYSNEWKGLVRMVKYWNNNARHGEKPVKPSFLIEVMALQCLYGGWLGRFDYEIQGFFSTLADRITDEWPDPAGLGPAISDSMDSTRKQRARELLMAASRDATIAIDHVRRGRNGEALKVWRALFGPKFPLS

SEQ ID NO: 4250 - protein, 299 aa, Nitrobacter sp.
MLTVDEAFRKFKSRLELNDKEQKNASARHTEVRDYLATKFKVDRSFLTGSYARHTKTKPLKDIDIFFVLKEDEKHYRSKAPSVVIGDFHDELVDKYGKDAVRKQSRSVNVDFGVVVDAEDNTDYRVVSVDVVPAFTAGDNYEIPDDDTGKWIKTNPEIHASKATAAHQAYSNEWKGLVRMVKYWNNNARHGEKPVKPSFLIEVMALQCLYGGWQGRFDYEIQGFFSTLADRIFDQWPDPAGLGPAISDGMDSTRKQRARELLMAASRDATIAIDHARRGRNGEALKAWRALFGPKFPLS

SEQ ID NO: 4251 - protein, 299 aa, Rhizobiales bacterium
MLTVDDAFRKFKSRLELNDREQKNASARQTEVRDYLVTKFGIERSFLTGSYARYTKTKPLKDIDIFFVLKESEKPYRSKAPTVIIGDFYDALVEKYGKSAVRKQSRSVNVDFGVVIDAEDNTDYRVVSVDVVPAFASGDDYEIPDTDTGKWIKTNPEIHARKATAAHQAFSNEWKGLVRMVKYWNNHARHGEKPVKPSFLIEVMALQCLYGNWQGRFDYEIQGFFSTLADRVLDTWPDPAGLGPAISDGMDTARKQRARELLMAASRDATVAIDHARRGRNGEALKAWRALFGPKFPLS

SEQ ID NO: 4252 - protein, 299 aa, Bradyrhizobium sp.
MITLDDAFRKFKSRLELNDREQKNASQRQNEVRDYLDTKFAIERSFLTGSYARHTKTKPLKDIDIFFVLKESERHYRSKAPSVILTAFYDALVEKYGAKAVRKQSRSVNVDFGVTVDAEDNTDYRIVSVDVVPAFTSGDDYEIPDDDKGEWIKTNPETHAAKAVAAHQAFSNEWKGLVRMVKYWNDNARHGEKPVKPSFLIEVMALECLYGGWQGRFDYELQGFFSTLADRISETWPDPAGLGPPISDGMDAARKSRARDLLVAASREAPLAINHARQGRNGEALKVWRALFGPKFPLS

SEQ ID NO: 4253 - protein, 300 aa, Sphingopyxis bauzanensis
MTLTTEEAFRKFKSRLELNDKEQANASKRHTEVRDFLRTRFAIDRDFLTGSYKRWTKTKPLKDIDIFFVLGDDEKAYRQKTPSVVIDDFHAALVDKYGEDSVRKQGRSVGISFGVVPDADDNTDYRVLSIDVVPSFADGDDYEIPDRDLGEWIRTNPETHAQKATTAHQAFSSEWKGLVRMVKYWNNQARHGEKPVKPSFLIEVMALECLHGGWHGRFDYEIQAFFSTLADRIFDAWPDPAGLGPPVSDGMDLARKTRARDLLQQASREATLAIDHARRGRNGEALKAWRALFGPKFPLS

SEQ ID NO: 4254 - protein, 299 aa, Sphingomonas sp.
MLTIDDAFRKFKSRLELNDREQANASVRQNEVRDYLAAKFSIERSFLTGSYKRHTKTKPLKDIDIFLQLGKAERHYRDKSPDTVIDAFYDALVEKYGTAAVRKQTRSVNVDFGVVADAEDNTDYRIVSVDVVPAFACDDDYEIPDRDKGTWILTNPETHAAKATAAHQAHSSEWKGIVRMVKYWNNNPKHREKAVKPSFLIEVMALECLHAPWGGSFAYELQAFFQTLADRIDDVWPDPAGLGPPVSDCMDANRRARARTLLATASRDASQAIRHAREGRGGDALKAWRALFGPKFPLS

SEQ ID NO: 4255 - protein, 299 aa, Bradyrhizobium sp.
MLTTNEAFRKFKSKLELNQREEDNARSREQEVREYLDTKFSIVNDFLTGSYARWTKTKPLKDVDIFFVLNPNKHDYRSKAPSVVLTDFYDALVGKYGDKAVKKQGRSINVDFGVHADADDNTDYRIMSVDAVPAFVAEADYEIPDKDLGKWIKTNPKTHAEKATAAHQAYSSEWKGLVRMVKYWNNNPKHGEKPVKPSFLIEVMALEVLYGGFGGSFDREIQGFFATLADRIFDTWPDPAGLGPPISDGMDQARKQRARDLLRAAEQEAAYAIDLGRKGRQGDSLKAWRALFGRKFPIS

SEQ ID NO: 4256 - protein, 299 aa, Bradyrhizobium sp.
MLTTNEAFRKFKSKLELNQREQDNASSREKEVRNYLDTKFSISSDFLTGSYARWTKTKPLKDVDIFFVLNPNKHDYRSKSPSVVLADFHDALVKKYGDKAAKKQGRSINVDFGVHVDAEDNTDYRIMSVDAVPAFEAGGDYEIPDNDLGRWIKTNPKTHAEKATAAHQAYSSEWKGLVRMVKYWNNNPKHGEKPVKPSFLIEVMALEVLHGGFGGSFDREIQGFFATLADRIFDTWPDPAGLGPPISDGMDQARKERARTLLRAAERDAAFAIDLSRKGRQGDSLKAWRALFGPKFPIS

SEQ ID NO: 4257 - protein, 299 aa, Bradyrhizobium japonicum
MLTTNEAFRRFKSKLELNQREQDNARSREQEVRQYLDTKFSINNDFLTGSYARWTKTKPLKDVDIFFVLNPNKRDYRTEEPSVVLGDFHDALVDKYGDKAVKKQGRSINVDFGVQVDAEDNTDYRIMSVDAVPAFVAGADYEIPDKDLGKWIKTNPKTHAEKATAAHQAYSSEWKGLVRMVKYWNNNPKHGEKPIKPSFLIEVMALEILYGCFGGSFDREIQGFFATLADRIFDTWLDPAELGPPISDGMDRDRKERARGLLLAAEQEAAFAIDLARKGRQGDSLKAWRALFGPKFPIS

SEQ ID NO: 4258 - protein, 301 aa, Polaromonas sp.
MLTVEEAFRKFKSRLELNEREKQNASKRHTEVREHLRARFAVDRDFLTGSYARYTKTKPLKDIDIFFVLADSERKRYRDQPPNVVLDDFCKALVDKYGRDAVRKQGRSVSVDFGVVIDAEDNTDYRVVSVDVVPAFAVGGDYEIPNADTGKWMKTNPEIHAQEARDAHQAFSNEWKGLVRMVKYWNNNAKHGKDKPVKPSFLIEVMALQCLHGGWQGRFDYEIQAFFASLADRVLDEWPDPAGLGSPVSDGMDDQRKVRAKELLQAASRDAANAIQLTKRGLNGDALKAWRQLFGPKFPLS

SEQ ID NO: 4259 - protein, 301 aa, Azoarcus toluclasticus
MLTQDEAFRKFKSRLELNDRERQNASKRHTEVREHIRSRFSIDRDFLTGSYARYTKTKPLKDIDIFFVLAESERKKYRDKVPSVVLDDFYNALVDKYGKSAVRKQGRSVNVDFGVVVDAEDNTDYRVVSVDVVPAFVDGDNYEIPNSDTGKWMKTNPNIHAQEARDAHQAYSNEWKGLVRMVKYWNNNAKHGADKPVKPSFLIEVMALQCLHGGWQGRFDYELQAFFAALADRVQDEWPDPAGLGSPISESMDGQRKARAKELLQAASREASNAIHLARKGQNGEALKAWRLLFGPKFPLS

SEQ ID NO: 4260 - protein, 301 aa, Ralstonia solanacearum
MISLDDAFRKFKSRLELNDREQANASKRHTEVREHIRSKFSIQRDFLTGSYARHTKTKPLKDIDIFFVLSDAEEEKYRPQAPSVVLDDFYEALVEKYGKEAVRKQGRSINVDFGVVVDAEDNTDYRVLSVDVVPAVAIGADYEIPNSDTGKWMKTNPDIHANEARDAHQAFSCEWKGLVRMVKYWNNNPKHGADKPVKPSFLIEVMALECLHGGWQGRFDYELQTMFSSLADRIKDEWPDPAGLGSPISDGMDDARKNRAQQLLRAASREASNAIHLARKGQNGEALKAWRALFGPKFPLS

SEQ ID NO: 4261 - protein, 299 aa, Unknown
  Description of Unknown: Mesorhizobium sequence
MLTVDEAFRKFKSRLELNDREQKNASARQTDVRDYLFGKFAVADSFLTGSYKRHTKTKPLKDIDIFFVLKDAERHYRDKAPTAVIDDFAKALVDKYGEKAVRKQSRSVNVDFGVVVDADDNTDYRILSVDVVPAFVAGDNYEIPDTHTGKWIKTNPKIHAEKATAAHQAFSNEWKGLVRMVKYWNNNTRHREKPIKPSFLIEVMALQCLYGDWQGRFDYELQGFFSTLADRIFDEWPDPAGLGPAISNGMDQTRKQRARDLLMAASREASVAIDHGRNGRNGDALKAWRALFGAKFPLS

SEQ ID NO: 4262 - protein, 299 aa, Roseovarius mucosus
MISLPDAFKKFKSRMELNESERQNASKRQKEVREHLDKALQIDRSFLTGSYARWTKSKPLKDVDIFFVLGKDEDHYRDKHPDKILTAFYDTLVDVYGSSAVKKQARSVGVDFGVVVDSDDNTDYRVVSVDAVPAFAKGDDYEIPNNTTGKWMGTNPEIHAQKAVAAHQAYGNEWKGLVRMVKYWNQNSRHGEKPIKPSFLIEVMAMECLHGGWGGSHDREIQAFFATLRDRIHEDWPDPAGLGSPVSDRMDAAMVKRAQTILDQANREIAAAIHLARQGKNGDALKAWRAFFGPKFPLS

SEQ ID NO: 4263 - protein, 299 aa, Roseovarius mucosus; identical to SEQ ID NO: 4262

SEQ ID NO: 4264 - protein, 299 aa, Sulfitobacter geojensis
MISLPDAFKKFKSRMELNEREQQNASKRQKEVREHLDKAFQIDRSFLTGSYARWTKSKPLKDVDIFFVLGKDEDHYRDKHPDKILTAFYDTLVDVYGSSAVKKQGRSVGVDFGVVVDSDDNTDYRVVSVDAVPAFAKGDDYEIPNNTTGKWMGTNPEIHAQKAVSAHQAYGNEWKGLVRMVKYWNQNSRHGEKPIKPSFLIEVMAMECLHGGWGGSHDREIQAFFATLRDRIHEDWPDPAGLGSPVSDRMDAAMVKRAQTILDQANRDIAAAIHLARQGKNGDALKAWRAFFGPKFPLS

SEQ ID NO: 4265 - protein, 299 aa, Loktanella marina
MISLPDAFKKFKSRMELNEREQQNASKRQKEVREHLDNAFQIDRSFLTGSYARWTKSKPLKDVDIFFVLGKDEDHYRDKHPDKILTAFYNTLVDVYGSSAVKKQGRSVGVDFGVVVDSDDNTDYRVVSVDAVPAFAKGDDYEIPNNTTGKWMGTNPEIHAQKAVSAHQAYGNEWKGLVRMVKYWNQNSRHGEKPIKPSFLIEVMAMECLHGGWGGSHDREIQAFFATLRDRIHEDWPDPAGLGSPVSDRMDAAMVKRAQTILDQANRDIAAAIHLARQGKNGDALKAWRAFFGPKFPLS

SEQ ID NO: 4266 - protein, 299 aa, Tropicibacter phthalicicus
MISLPDAFKKFKSRMELNEREQQNASKRQKEVREHLDKAFQIDRSFLTGSYARWTKSKPLKDVDIFFVLGKDEDHYREKHPDKILTAFYDTLVDVYGSSAVKKQGRSVGVDFGVVVDTGHNTDYRVVSVDAVPAFAKGDDYEIPNNTTGKWMGTNPEIHAQKAVAAHQAYGNEWKGLVRMVKYWNQNSRHGEKPIKPSFLIEVMAMECLHGGWGGSHDREIQAFFATLRDRIHEDWPDPAGLGSPVSDRMDASMVQRAQAILDQANRDIAAAIHLARQGKNGDALKAWRAFFGPKFPLS

SEQ ID NO: 4267 - protein, 299 aa, Marinovum algicola
MISLPDAFKKFKSRLELNESERQNASKRQKEVREHLDKAFQIDRSFLTGSYARWTKSKPLKDVDIFFVLGKDEDHYRDKHPDKILTAFYDKLVDVYGSSAVKKQGRSVGVDFGVVVDSDDNTDYRVVSVDAVPAFANGDDYEIPNNTTGKWMGTNPEIHAQKAVAAHQAYGNEWKGLVRMVKYWNQNVRHGEKPIKPSFLIEVMAMECLHGGWGGSHDREIQAFFATLRDRIHEDWPDPAGLGSSVSDRMDAAMVTRAQTILDQANRDIAAAIHLARQGKNGDALKAWRSFFGPKFPLS

SEQ ID NO: 4268 - protein, 299 aa, Oceanicola sp.
MITLPEAFKKFKSRLELNDNEQKNASKRQTEVREFLDTKFQIDRSFLTGSYKRWTKTKPLKDVDIFFVLGEDERHYLNKHPDEILTAFDLALVEKYGRSAITKQGRSVGVDFGVVIDSDDNTDYRVVSVDAVPAFVEGDNYTIPNNATGKWMGTNPEIHAQKATEAHQAYGNEWKGLVRMVKYWNQNSRHGEKPIKPSFLIEVMAMECLHGGWGGSHDRELQAFFATLRDRIHEDWPDPAGLGSPVSDRMDAAAIARAQSILDTANREIANAINLARRGQNGEALKAWRAFFGPRFPLS

SEQ ID NO: 4269 - protein, 299 aa, Labrenzia sp.
MITLQDAFKKFKSRLELNDKEQNNASKRQIEVREYLDTKFDIDRSFLTGSYARWTKTKPLKDVDIFFVLGDEEKHYRDKHPDAILTAFDDALVEKYGRSAVTKQSRSVGIDFGVVVDADDNTDYRVVSVDAVPAFVEGKNYVIPNNDTGKWMGTNPEIHADKATEAHQAYSNEWKGLVRMTKYWNQNARHGEKPIKPSFLIEVMAMQCLWGGWGGSFDREIQSFFATLRDRIHEDWPDPAGLGSPVSDRMNGAALTRAQSLLDAANRDIASAINLARSGRNGDALKTWRAFFGPKFPLS

SEQ ID NO: 4270 - protein, 293 aa, Asinibacterium sp.
MITTSEAFKKFKSRLELREAEQKDASRLQKEIREHIGNNFSIKNDFLTGSYGRHTKTRPLKDVDIFFVLDKEKEKKYLTDPLLVLSDFKKCLAKKYGESKVSIGRRSVGIDIALGTTEEDKVLSIDAVPAFEVSNYYQISDNVLCDWIKTDPQIHAEKATEANKAFDGEWKPMVKMIKKWNETQGKPIKPSFLIEVMAMQILYPPFSGGYVYELKSFFATAFDRIGETWNDPAGLGSPVSDQMDASKITTARQKLSEVGKFIDQAVLLEKQGNQGGALRIWRDNIFGDMFPLS

SEQ ID NO: 4271 - protein, 293 aa, Niastella populi
MINTFDAFKKFKSRLELRDGEQKKASKLQQDARALVGEHFVIARDFLTGSYKRHTKTRPLKDVDIFFVLDKEKEKKYLDNPLGLLEDIRKVLAPVYGEAKVKVGRRSVGVDLAYDPNDEDKILSIDVVPAFDKDNHYQIPDNVLQDWVNTDPEIHAEEATAANKAFDGEWKPMVKMIKKWNETQGKPIKPSFLIEVMAMQMLYPPFSGGYVYELKSFFATAADRISETWNDPAGLGSPVSDQMDAQRITLARQKLAEAGKFVDQAIQAERNGNQVGALRIWRDNVFGDMFPLS

SEQ ID NO: 4272 - protein, 293 aa, Parafilimonas terrae
MINTIEAFKKFKSRLELRAGEQKKASELQQEVRALIGEHFSIEKDFLTGSYKRHTKTRPLKDVDIFFVFDKEKEKKYLNKPLELLEDIRKVLAPKYRETKVKIGRRSVGVDLPYDPNDEDKILSIDVVPAFDAGKHYQIPDNVLKTWINTDPEIHAEEATAANKAFDGEWKPMVKMIKKWNETQGKPIKPSFLIEVMAMQILYPPFSGGYVYELKSFFATAADRIAETWNDPAGLGAPVSDQMDANRITLARQKLAEAGKYVDQAIQLEKKGNQGGALRIWRDNIFGDMFPLS

SEQ ID NO: 4273 - protein, 293 aa, Rubricoccus marinus
MISLDDAFAKFKSRLELNDREQKDASRRHYELRDHVKAAFTVDRDVLTGSYARHTKTKPLKDVDVFFTLSRDAHGDYLTEKPSVLLGDVKTCLVDAYGRSCVDLGRRSVGVELGVAGQDDRVLSLDAVPAFAENGHYLIPDGWDETWVKTDPERHAALATDANKAFGKQWKPVVKMVKKWNEHHGKPIKPSFLIEVMALELLRPPFSGGYVYELKAFFATARDRIRETWDDPVGLGTPVSDRMDAAQCSVAEAALDDAGRHVDRAVQAKRAGRNGDALDIWRNDVFGPLFPLS

SEQ ID NO: 4274 - protein, 298 aa, Schlesneria paludicola
MITVAEAFKKFRSRLELSDREQDDASRRHNEIRDFLKTMFDVENDFLTGSYKRWTKTKPLKDVDIFCVLGQKERHRRDKPPGDLLKAFEDALVEKYGRDKVSRQRRSVTVDFGVTTNEDEDTGGKVMSFDVVPAFTKNNHYEIPDTSTTSGWTETNPQVHHDLAVEAQKKYDGEWKGIVRMTKKWNANQGKPVKPSFLIEVMALELLHPPFGGDYRFEIKAFLASLADRLDETWADPARLGPPVSDAMDQVARDAAKIKLRQGSDAAAKAIQLERQGKNGEALRVWRTEVFGPMFPLS

SEQ ID NO: 4275 - protein, 294 aa, Alphaproteobacteria bacterium
MITVDEAFDQFRQRLELSETEQQDAIRRHNDVRACIREGFDIDRDFLTGSYARHTKTKPLKDVDIFFCLGEKDRHWRSKPPSDVLAAFETCLAKKYGNDSVERGRRCVTVEFDKQNPTADEEGKVLSNDAVPAYELDDCYEIPDRDLGKWIKTDPDVHKEKSTAKNKECGGKWVPLVKMLKRWNRSADKPISPSFLIEVMALDLIDPPFTKYQSEVRRFFAAAQEGIMRDWPDPAGYGPPVSDQMTPNKRRKAVEALRAAEVKAARAVHLEQQGKTGEALALWREIMGKYFPVS

SEQ ID NO: 4276 - protein, 259 aa, Bradyrhizobium elkanii
MRDCICGGFDIDRDFLTGSYDRHTKPLKDVDIFFALGSKDQHWGSKAPSEVLDAFVDRLRGEFGKDAVQPGRRCATVEFERNTNDKEGKVLSIDAVPAIELSDCYEIPDRDLGKWIKTDPEIHAEKSTAKNKTLSGKWVPLVKMLKRWNRSADKPIKPSFLIEVMAQDLVDGPFTTYPGEVRRFFAAALEGIRREWKDPAGLGPPVSDQMTPELIKKAEAALRRAETEASRAVRLAQQGKQGEALAVWALIMGRYFPKS

SEQ ID NO: 4277 - protein, 292 aa, Bradyrhizobium sp.
MITVDEAFETFRQRLELSETERTDTIRKHNKVRDCIRGGFHIDRDFLTGSYDRHTKTKPLKDVDIFFTLGSKDQHWRSKAPSEALDAFVDRLRREFGKDAVQPGRRCATVEFERNTSDKEGKVLSIDAVPAIELSDCYEIPDRDLGKWIKTDPEIHADKSTTKNKSLSGKWVPLVKMLKRWNRSSDKPIKPSFLIEVMAQDLVDGPFTTYPGEVRRFFAAALEGIRQEWKDPAGLGPPVSDQMTPELIKKAEAALRRAETEASRAVRLAQQGKQGEALAVWASIMGRYFPKS

SEQ ID NO: 4278 - protein, 293 aa, Rhizobium leguminosarum
MITTEEAFEKFRQRLELSEAERKDTIKRHEEVRGVIKADFAVDRDVLTGSYKRHTKTKPLKDVDVFFVLSKKERDKYRDKPPADLINAFVKSLRGTYGYDAVEPGRRCATVEFEKNTKDEEGKVLSIDAVPAFDIGDCYEIPDRVRGDWVKTDPEIHMEQATKKNKELGGKWIPLVKMIKRWNRSAGKPIRPAFLIEVMMQDLVDPPFTTYPSEVRRFFAAAQEAIEQVWPDPAGYGPPVSEQMTPELVKAAKEALRQADIKAALAVRLEKQGKQGEAIALWREIMGRYFPTK

SEQ ID NO: 4279 - protein, 293 aa, Rhizobium sp.
MITTEEAFEKFRKRLELSEAERKDTIKRHEEVRGVIKADFAVDRDVLTGSYKRHTKTKPLKDVDVFFVLSKKERDKYRDKPPADLINAFVKSLRGTYGYDAVEPGRRCATVEFEKNTKDEEGKVLSIDAVPAFDVGDCYEIPDRVRGDWVKTDPEIHMEQATKKNKELGGKWIPLVKMIKRWNRSAGKPIKPAFLIEVMMQDLVDAPFTTYPSEVRRFFAAAQEGIEQAWPDPAGYGPPVSEQMTPELVKVAKEALRQADIKAALAVQLEKQGKQGEAIALWREIMGRYFPTK

SEQ ID NO: 4280 - protein, 293 aa, Rhizobium sp.
MITTEEAFEKFRQRLELSETERKDTIERHEEVRGVIKGDFVVDRDILTGSYKRHTKTKPLKDVDVFFVLGKKERDKYRDKPPADLINAFVKTLRATYGDAAVEPGRRCATVEFDKNTTDEEGKVLSIDAVPAFDIGDCYEIPDRIRGDWVKTDPEIHMEQAIKKNKELGGKWIPLVKMIKRWNRSAGKPIKPAFLIEVMMQDLVDPPFTTYPSEVRRFFAAALDGIEREWPDPAGYGPPVSEQMTPELIKAAKETLRQAEMKAARAVQLEKQGKQGDAIALWREIMGRYFPTK

SEQ ID NO: 4281 - protein, 293 aa, Rhizobium leguminosarum
MITTEEAFETYRKRLELSETERKNTIKRHEEVRGVIRGSYAVDRDILTGSYGRHTKTKPLKDVDVFFILNQKERDNYRNKAPSVLLDAFAKTLSDSYGKDSVEPGRRCATVFFERNTTDEEGKVLSIDAVPAFDIGNCYEIPDRVLGSWIKTDPEIHKQEATAKNNELGGNWVPLVKMIKRWNRSAGKPIKPSFLIEVMMQDLVDAPFTTYPQEVRRFFAAALNGIEQQWPDPAGYGPPVSDQMTPALIATAKEKLRQAEMKATVAIRHEQQGRQSQAITAWREIMGKYFPAS

SEQ ID NO: 4282 - protein, 293 aa, Rhizobium leguminosarum
MITTEEAFETYRKRLELSETERKNTIKRHEEVRGVIRGSYAVDRDILTGSYGRHTKTKPLKDVDVFFILNQKERDNYRNKAPSVLLDAFAKTLSDSYGKDSVEPGRRCATVFFERNTTDEEGKVLSIDAVPAFDIGDCYEIPDRVLGSWIKTDPEIHKQEATAKNNELGGNWVPLVKMIKRWNRSAGKPIKPSFLIEVMMQDLVDAPFTTYPQEVRRFFAAALNGIEQQWPDPAGYGPPVSDQMTPALIATAKEKLRQAEMKATVAIRHEQQGRQSQAITAWREIMGKYFPAS

SEQ ID NO: 4283 - protein, 296 aa, Terriglobus saanensis
MRTTDQAFDKFRQNLELGPTESADAQKRHKDVRECIRKGFDVANDVLSGSYRRHTKTKPLKDVDVFFILGQKERWRRSKPPIDMLTAFDECLKKEFTDEGQTEIGRRAVTVVFEKNYYPDDHHGKVLSIDAVPAFEIETDVFEIPDKVTGTWIKTNPKKHQAQATAKNKEIDGYWVPLVKMIKGWNRANGKPIKPSFLIEVIAEELVESPFSTYANEVRNFFAAMEANIGREWPDPAGLGPLVSDQMTPKMITAAKTALQEAQRKAALACRAERTGRQGEALKIWREILGPYFPLT

SEQ ID NO: 4284 - protein, 293 aa, Catenulispora acidiphila
MMSIEDAFGKFRTRLETTDRENATASARQQRIREQLASDLEIAEDFLTGSYRRQTKTKPLRDIDIMVVLRDTNFLNRDPAAILKEVVQILEPYYPGRVVSDRRAVRVDFGVARVTDLDDEIISFDVVPAFADGDNYLIPDDILGEWISTNPRIHAELATRANKDFADQWKPLIKMIKKWNQESGSPVQPGFLLEVMALDILSGPWTGRHPYELRGFFATAADRIDEGWPDPAGLGPDVSDVLDNDPAAMAVSRRALGEAEAACTRAIKHDQAGRTGEALAEWQRLFGSLFAKS

SEQ ID NO: 4285 - protein, 298 aa, Micromonospora nigra
MISVNDAFYKFRSNLETTDTEDASASARQKRIREQLDADDTLDITRDFLTGAYRRHTKTKPLRDVDIMIVLGNTEYLGRHPHDILEVVRAALVPYYGEARVCCDRRAVRVDFGVRIVDDVSDADEVVSFDVVPAFVNDDHYLIPDDVTGEWVHTNPELHYDAARDANKDFAEQWKPLVKMIKKWNQVAGHPVEPSFLIEVMALKLITGPWTGSHPRELRQFFASAASRIDEGWPDPANIGPDVSDVVDNDPAKMDTARKALRAAEAACTAAINFDRTGRTGEALTAWRALFGPLFPLS

SEQ ID NO: 4286 - protein, 295 aa, Streptomyces galbus
MMNVSEAFEKFRGNLEITPTESAQASNRQQRMREQLDHSTLDVADTFLTGAYRRATKTKPLADVDIMVVLNDRAYLDKHPHEILEAVRAILAPIYGEDRVCCDRRAVRVDFGVKLVDDLTGGVVSFDVVPAFIEDDHYLIPDDVLAEWIPTNPKIHADLATQANKDFAEQWKPLVKMVKTWNREHGHPIEASFLIEVMALELIKGDWIGPYPRELRQFFATAVNAVTERWPDPAHLGPDVSDMFVGQPEKLQAAQTALRAAEAACTEALLLERAGRTGDALAKWQLLFGPLFTKS

SEQ ID NO: 4287 - protein, 294 aa, Streptomyces galbus
MNVSEAFEKFRGNLEITPTESAQASNRQQRMREQLDHSTLDVADTFLTGAYRRATKTKPLADVDIMVVLNDRAYLDKHPHEILEAVRAILAPIYGEDRVCCDRRAVRVDFGVKLVDDLTGGVVSFDVVPAFIEDDHYLIPDDVLAEWIPTNPKIHADLATQANKDFAEQWKPLVKMVKTWNREHGHPIEASFLIEVMALELIKGDWIGPYPRELRQFFATAVNAVTERWPDPAHLGPDVSDMFVGQPEKLQAAQTALRAAEAACTEALLLERAGRTGDALAKWQLLFGPLFTKS

SEQ ID NO: 4288 - protein, 295 aa, Streptomyces sp.
MISVSEAFENFSGNLEITPTESVQASKRQQRMREHLDDSILDIADTFLTGAYRRATKTKPLTDVDIMAVLDDRTYLDKHPHQVLEDVRAILAPIYGEDRVCCDRRAVRVDFGVKLVDDLTGDVVSFDVVPAFTEDDHYLIPDDVLAKWIPTNPKVHEDLAVQANKDFSERWKPLVKMIKTWNRHHGHPIEASFLIEVMALELVKGEWVGPYPRELRQFFATAVNAVAERWPDPAHLGPDVSDIFDGQPEKLQAAQTALRAAEAACTEALRLERAGRTGDALAQWQLLFGPLFTKS

SEQ ID NO: 4289 - protein, 284 aa, Clavibacter michiganensis
MSKVDDAFGRLKSNLEITAAEQTQAASRHALIRDHLRTRWALTDDFLTGSYDRHTKTKKLKDVDIFVVIDPDGPQGQLANGPGRAAVEALADVLSSRWSSVDFDDNVARVSYADEEVASYEVAPAFATNEGFVIPNGSSWMATNPSVHAKLVTAKNADVDKKFIPLVKMIKAINREQGEPISPSFLIEVMALDLIVAPAAAYKQEVSFFLAAAADAIHEDWRDPAGLGEHVNAHMTPSDRDRASVEIRRWQLIAENARRLEDRGEESAAIEEWRKLFGARLTRS

SEQ ID NO: 4290 - protein, 284 aa, Clavibacter michiganensis
MSKVDDAFGRLKSNLEITAAEQTQAASRHALIRDHLRTRWALTDDFLTGSYDRHTKTKKLKDVDIFVVIDPDGPQGQLANGPGRAAVEALADVLSSRWSSVDFDDNVARVSYADEEVASYEVAPAFATNEGFVIPNGSSWMATNPSVHAKLVTAKNADVDKKFIPLVKMIKAINREQGEPISPSFLIEVMALDLIVAPAAAYKQEVSFFLAAAADAIHEDWRDPAGLGEHVNAHMTPSDRDRASVEIRRWQLIAENARRLEDRGEESAAIEEWRKLFGARMTRS

SEQ ID NO: 4291 - protein, 284 aa, Clavibacter michiganensis
MSKVDDAFGRLKSNLEITAAEQTQAASRHALIRDHLRTRWALTDDFLTGSYDRHTKTKKLKDVDIFVVIDPDGPQGQLANGPGRAAVEALADVLSSRWSSVDFDDNVARVSYADEEVASYEVAPAFATNEGFVIPNGSSWMATNPSVHAKLVTAKNADVDKKFIPLVKMIKAINREQGEPISPSFLIEVMALDLIVAPAAAYKQEVSFFLAAAADAIHEDWRDPAGLGEHVNAHMTPRDRDRASVEIRRWQLIAENARRLEDRGEESAAIEEWRKLFGARLTRS

SEQ ID NO: 4292 - protein, 284 aa, Rhodococcus zopfii
MGMVDTAFAALKSNLEITTSEQNLAQSRHKLIRDHVRTRWTLTDDFLTGSYDRHTKTKKLKDVDIFVVIDPEGPQAHLAEGTGTAAVRALVEVLSTRWPDVTGDDTVALISYAGEDVASYEVAPAFATETGFRIPNGVEWMDTNPHEHARMVTEKNADCDGKFVPLVKMLKAINREAGEPLNPSFLIEVMALDLVEPRLGRYQDEIRFFLASAADQIVDDWPDPAKLGGDVNAGVPASERADLQRVLRSWLQIAEEAILAESEGQERSAIELWRSLFGGRMPRP

SEQ ID NO: 4293 - protein, 284 aa, Mycobacterium heidelbergense
MTYVDDAFGGLKTNLEITTTERNLAVSRHHRIRDHIREYWSLNEDFLTGSYDRHTKTKKLKDIDIFIVIDPDGPQGHLANGTGTAAVTALREVIEQKWSDIAADDTVVTIYYSGEEVASYEIAPAFATDDGYKIPNGLHWMNTNPNEHARMVTEKNTKCDGKFVPLVKMLKGMNRQAGEPIQPSFLIEVMALELVESPVGAFKDEVRFLLASMADQITADWPDPAGLGPDVNAGSNSWQRSQQQTNIRGWLAAAEEAILLEAHGKERAAVDKWRELFGDRMPRP

SEQ ID NO: 4294 - protein, 288 aa, Streptomyces sp.
MGYIDDAFTKLKHNLEITQTEQNLAKARHEAIRDFVRSHWDLADDFLTGSYRRDTKTKKLKDIDIFVVLDATGSQAGFRDQAPIQVINALETLLRQKWSAAARDGMAVVIPYGPDDEVMSIDVVPAFKRGEGGYYIPNPSAGDWIATNPKRHHELSIAKNADCDGKYVPFVKMVKGINRELGEPVSPSFLLEVMAQSLVKPPIGRYQDEIVLFLATAAERIGDEWPDPAGLGGDVNAVMNATQKLAAANALTQARAIAERAVDLEDEGQERAAYDEWKKLFGNRTTRP

SEQ ID NO: 4295 - protein, 288 aa, Unknown
  Description of Unknown: Frankia sequence
MAYIDDAFAKLKHNLEITQTEQNLAKARHETIRDFVTSHWDLADDFLTGSYRRDTKTKKLKDIDIFVVLDSDGSQAGFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAAERIGDEWPDPAGLGGEVNAVMNTTQKLAAANALNQARVIAERAVDLEDEGQDRAAYDEWRKLFGNRMTKP

SEQ ID NO: 4296 - protein, 288 aa, Frankia sp.
  MOD_RES (218)..(220): Any amino acid
  MOD_RES (225)..(225): Any amino acid
  MOD_RES (227)..(227): Any amino acid
  MOD_RES (281)..(281): Any amino acid
  MOD_RES (284)..(284): Any amino acid
MAYIDDAFAKLKHNLEITQTEQNLAKARHETIRDFVTSHWDLADDFLTGSYRRDTKTKKLKDIDIFVVLDSDGSQAGFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAXXXIGDEXPXPAGLGGEVNAVMNTTQKLAAANALNQARVIAERAVDLEDEGQDRAAYDEWRKLXGNXMTKP

SEQ ID NO: 4297 - protein, 288 aa, Frankia sp.
  MOD_RES (53)..(53): Any amino acid
  MOD_RES (227)..(227): Any amino acid
MAYIDDAFAKLKHNLEITQTEQNLAKARHETIRDFVTSHWDLADDFLTGSYRXDTKTKKLKDIDIFVVLDSDGSQAGFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAAERIGDEWPXPAGLGGEVNAVMNTTQKLAAANALNQARVIAERAVDLEDEGQDRAAYDEWRKLFGNRMTKP

SEQ ID NO: 4298 - protein, 288 aa, Frankia sp.
  MOD_RES (225)..(225): Any amino acid
  MOD_RES (227)..(227): Any amino acid
MAYIDDAFAKLKHNLEITQTEQNLAKARHETIRDFVTSHWDLADDFLTGSYRRDTKTKKLKDIDIFVVLDSDGSQAGFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAAERIGDEXPXPAGLGGEVNAVMNTTQKLAAANALNQARVIAERAVDLEDEGQDRAAYDEWRKLFGNRMTKP

SEQ ID NO: 4299 - protein, 288 aa, Frankia sp.
  MOD_RES (77)..(77): Any amino acid
MAYIDDAFAKLKHNLEITQTEQNLAKARHETIRDFVTSHWDLADDFLTGSYRRDTKTKKLKDIDIFVVLDSDGSQAXFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAAERIGDEWPDPAGLGGEVNAVMNTTQKLAAANALNQARVIAERAVDLEDEGQDRAAYDEWRKLFGNRMTKP

SEQ ID NO: 4300 - protein, 288 aa, Frankia sp.
  MOD_RES (73)..(73): Any amino acid
MAYIDDAFAKLKHNLEITQTEQNLAKARHETIRDFVTSHWDLADDFLTGSYRRDTKTKKLKDIDIFVVLDSDXSQAGFRDQAPIQVINALETLLRQKWSAAARDGMAVVIPYGADDEVMSIDVVPAFKRKDGGYYIPNPSAGDWIATNPKRHHELSIAKNADCDGKYVPFVKMIKGINRELGEPVSPSFLLEAMAQSLVKPPFGRYQDEIVLFLATAAERIGDEWPDPAGLGGEVNAVMNTTQKLAAANALNQARVIAERAVDLEDEGQDRAAYDEWRKLFGNRMTKP

SEQ ID NO: 4301 - protein, 288 aa, Pseudonocardia sp.
MGYIDDAFAKLKHNLEITQTEQDLAKARHEAIRDFVKSRWDLADDFLTGSYRRDTKTKKLKDIDIFVVLDADGSQAGFRDQAPIQVINALETLLRQKWSAAARDGMAVVIPYGADDDVMSIDVVPAFKREDGGYYIPNPSAGDWLATNPKRHHELSIAKNADCDDKYVPFVKMIKGINRELGEPVSPSFLLEVMAQSLAKPPIGRYQDEIVLFLATAAERIGDEWLDPAGLGGDVNAVMNATQKLAAADALNQARAIAERAVDLEDDDQERAAYDEWKKLFGNRMTRP

SEQ ID NO: 4302 - protein, 286 aa, Amycolatopsis benzoatilytica
MGYIDDAFAKLKHNLEITQTEQNLAKARHEAIRDFVKSHWDLADDFLTGSYRRDTKTKKLKDIDIFVVLDADGTQAGFRGQAPIQVINALETLLRQKWSAAARDGMAVVIPFGADDDVMSIDVVPAFKREDGGYYIPNPSAGDWLATNPKRHHELSIAKNADCDGKHVPFVKMIKGINRELGEPVSPSFLLEVMAQSLVKPPIGRYQDEIVLFLATAAERIGDEWLDPARSRRRRQRRHERHPETRRGRRAQQSTRHRRAGGRPGGRRPRPRRLRRVEEALREPDD

SEQ ID NO: 4303 - protein, 288 aa, Amycolatopsis thailandensis
MGYIDDAFTKLKHNLEITQTEQNLAKARHEAIRDFVKSHWDLDDDFLTGSYRRDTKTKKLKDIDIFVVLDADGGQSSFRDQSPIQVINALETLLRQKWSSAARDGMAIVVPYGADDEVMSIDVVPAFKREDGGYYIPNPSAGDWLETNPKRHHELSIAKNADCGGKYVPFVKMIKGINRELGEPVSPSFLLEVMAQSLVKPPIGRYQDEIIYFLATAAERIGDEWPDPAGLGGDVNAVMNMTQKLAAANALNRARAIAERAVDLEDDGQDRAAYDEWKTLFGNRMTKP

SEQ ID NO: 4304 - protein, 288 aa, Actinobacteria bacterium
MGYVDDAFTKLKHNLEITQTEQDLAKARHEAIRDFVRSHWDLADDFLTGSYRRDTKTKKLKDIDIFVVLDANGSQAGFRDQSPIQVINALETLLRQKWSSAARDGMAVVIPYGPDDEVMSIDVVPAFKRADGGYYIPNPSAGDWIATNPKRHHELSIAKNGDCDGKYVPFVKMVKGINRELGEPVSPSFLLEVMAQSLVKPPIGRYQDEIVLFLATAAERIGDEWPDPAGLGSDVNAVMNATQKLAAANALNQARAIAEGAVDLEDEGQERAAYDEWKKLFGNRMTKP

SEQ ID NO: 4305 - protein, 288 aa, Unknown
  Description of Unknown: Streptomyces sequence
MGYIDDAFANLKHNLEITPTEQKLAKARHEAIRDFVRSHWDLADDFLTGSYRRDTKTKKLKDIDIFVVLDANGSQADFRDQAPIQVINALEKLLRQKWSDAARDGMAIVIPYGPDDEVMSIDVVPAFKRGDGGYYIPNPSAGDWIATNPKRHHELSIAKNADCDGKYVPFVKMVKGINRELGEPVSPSFLLEVMAQALVKPPIGSYQDEIVSFLATAAERIGDEWPDPAGLGGNVNAVMNATQKLAAANALNQARAIAERAVDLEDEEQERAAYDEWKKLFGNRMTRP

SEQ ID NO: 4306 - protein, 288 aa, Streptomyces prasinus
MGYIDDAFTKLKHNLEITQTEQNLAKARHEAIRDFVRSHWDLADDFLTGSYRRDTKTKKLKDIDIFVVLDADGSQAGFRDQAPIQVINALETLLRQKWSSAARDGMAVVIPYGPDDEVMSIDVVPAFKRDEGGYYIPNPSAGGWIATNPKRHHELSIDKNADCDGKYVPFVKMVKGINRELGEPVSPSFLLEVMAQSLVKPPIGRYQDEIVLFLATAAERIGDEWPDPAGLGGDVNSVMNATQKLAAANALTQARSIAEQAVDLEDEGQERAAYDEWKKLFGNRMTRP

SEQ ID NO: 4307 - protein, 288 aa, Streptomyces sp.
MGYIDDAFTKLKGNLEITQTEQSLAKTRHEAIRVFVRSHWDLADDFLTGSYRRDTKTKKLKDIDIFVVLDADGSQAGFRDQAPTQVINALETLLRQKWSSAARDGMAVVIPYGPDDEVMSIDVVPAFKRDEGGYYIPNPSAGDWIATNPKRHHELSIDKNADCGGKYVPFVKMVKGINRELGEPVSPSFLLEVMAQSLVKPPIGRYQDEIVLFLATAAERISDEWPDPAGLGGDVNAVMNATQKLAAANVLNRARTIAERAVDLEDEGQERAAYDEWKQLFGNRMTRP

SEQ ID NO: 4308 - protein, 288 aa, Saccharothrix sp.
MGYIDDAFAKLKSNLEITKTEQDLAKARHEAIRDYVKLHWDLADDFLTGSYRRDTKTKKLKDIDIFIVIDDEGSQAGYRDQAPIQVINALETLLRQKWSDASRDGMAVVIPYGGDDEVMSIDVVPAFDREGGGYFIPNPSAGGWIATNPKRHHELSIAKNADCGGKYVPFVKMIKGINRELGEPVSPSFLLEVIAQSLVKPPISRYQDEIVLFLATAAERIGDEWPDPAGLGGDVNAVMNATQKLVAVDALNQARVIAERAVDLEDEGQERAAYDEWKKLFGNRMTRP

SEQ ID NO: 4309 - protein, 295 aa, Nocardia jejuensis
MELGTPAMGYIDDAFDNLRHNLEITQTEQDLAKARHTAIRDFVNSHWDLADDFLTGSYRRDTKTKKLKDIDIFVVLDAEGFQASFRDQAPVQVINALESLLRQKWKHAARDGMAVVIPYGPDDDVMSIDVVPAFKREDGGYYIPNPSAGDWIATDPKRHHELSIAKNTECDGKYVPFVKMVKGINREVGEPVSPSFLLEVIALSLVKPPIGRFQDEIVLFLATATERIDDEWPDPAELGGDVNAVMNATQKLAAANALDQARAIAERAVDLEDDGQDEAAYNEWRKLFGNRITKP

SEQ ID NO: 4310 - protein, 288 aa, Unknown
  Description of Unknown: Frankia sequence
MGYVDDAFVKLRHNLEITQTEQNLAKARHEAIRDFVRTHWALADDFLTGSYRRDTKTKRLKDIDIFVVIDAHGPQAGFRDQAPIEVINALETLIRRKWSAAARDGMAVVIPYGPNDEVMSIDVVPSFKRNGGGYYIPNPSAGDWIATNPKRHHELSIAKNADCGGNYVPLVKMIKGINRELGEPVSPSFLLEVMAQSLVKLPIGRYQDEIVLFLGTAAERIGDVWPDPAGLGGDVNAVMNTTEKLAAANALDRARRIAETAVDLEDEGQERAAYDQWKKLFGDRMTRP

SEQ ID NO: 4311 - protein, 288 aa, Frankia sp.
  MOD_RES (201)..(201): Any amino acid
MGYVDDAFVKLRHNLEITQTEQNLAKARHEAIRDFVRTHWALADDFLTGSYRRDTKTKRLKDIDIFVVIDAHGPQAGFRDQAPIEVINALETLIRRKWSAAARDGMAVVIPYGPNDEVMSIDVVPSFKRNGGGYYIPNPSAGDWIATNPKRHHELSIAKNADCGGNYVPLVKMIKGINRELGEPVSPSFLLEVMAQSLVKXPIGRYQDEIVLFLGTAAERIGDVWPDPAGLGGDVNAVMNTTEKLAAANALDRARRIAETAVDLEDEGQERAAYDQWKKLFGDRMTRP

SEQ ID NO: 4312 - protein, 288 aa, Lentzea waywayandensis
MGYVDDAFANLKHNLEITPTEQEQAASRHVSIRDFVRSHWDLADDFLTGSYRRDTKTKKLKDIDIFVVLDADGAQAGYRNQSPNQVIDALEKLLREKWDAATQDGMAVVIPYGPNDEVMSVDVVPAFKRKDGGYFIPDPSAGSWIATNPKVHHELSIAKNADCDGKYVPLVKMIKGINRELGEPVSPSFLLEVMAMSLVKTPFGRYQDEIVLFLATAAERIHDEWPDPAGLGGDVNGVMTTSQKIAAATALDGARALAEQAVDLEDDGEERAAYNEWKKLFGNRMTRP

SEQ ID NO: 4313 - protein, 336 aa, Unknown
  Description of Unknown: Rhodococcus sequence
MGHTVDGAFAEFDRNLNLDPQQREQAQHKHTAIRDVLDDAGFVATSFLQGSFARKTMLAPLKDVDIVIVLKDTHWEQLQGPDGPATAMAWFRRAIETVWPEAEFDEGDKPSGKALRVTFPDISFDIDLVPAFDLDGADVLIGDRDQQHWEPSNTRRQLRAVATRNQATGGRFVHQVRQLKALVKNHEEQLGFVKGILVESLAYAAIHTTKTDKRAVAESLEHAKNAVRGAVIEPAGDDDVTVKWSQSEREVAAGKFSDFAARAAEALDLEADGDTEAAIDIWHSLFGDSFPAATPRSPGAALAAWNTVGSRTSTGRPTTSTSGRQPTRPGRAWAPR

SEQ ID NO: 4314 - protein, 335 aa, Mycobacterium sp.
MGQTVDGAFAELDEELNLDPAQRKQAQERHNAIRAALDEAGIVSSSFLQGSFARKTMLKPLKDVDIVIVLKPELWERLCGPDGPKTAMTWFKTIVATHWPDAAFDEGDAPSAKALRVTFTDIDFDIDLVPAFDTENDDVLIGDREQQCWEPSNTRRQILAVSQRNQGTAGRFVHQVRELKSLVKSHSELEFIKGVVIESLAFAVITSKAKDKSAIADILEHARTAVRGPVIEPAGDDDVTVKWTPSERQVAVREFDGMAAQAAEALRLEADDDIAAAIDVWHDLIGHPFPAAESRTPVEALAAWNAAGSRTSTGRPTTTTSGRQRIHPGRAWAPR

SEQ ID NO: 4315 - protein, 334 aa, Nocardia cyriacigeorgica
MGQTVDGAFAELDEELNLDPAQRERAQERHNAIRDVLEDAGFVHTSFLQGSFARKTMLKPLKDVDIVIVLKAEHWAALSGPEGPQTAMDWFQAPVAKAWPDAKFDHGDKPSAKALRVTFADLDFTIDLVPAFDDDDEFVLIGDRDQKCWEPSNTRRQGRVVSERNQDTKGRFVHQVREMKALVKSNNDLKFIKGIVVESLAFAVIDRKMPDKYAVADVLEHAQTAVLDQVLDPAGDDDVTVKWTSAERQTAASTFASLATQAREALDLEQSDNDAALDVWHALFGDPFPQPDPRDPAVVLADWNGNGGRTSTGRPTASALAIQSIKPGRAWAPR

SEQ ID NO: 4316 - protein, 338 aa, Unknown
  Description of Unknown: Micromonospora sequence
MAPRTTAEAFDEFDASLNLYPREREQAQRRHQEITDVLTAAGIAKSTFLQGSFARKTMPKPLKDVDMVVVLAEVYRALWFGSGRGGPAAAMAAIRAVVAAHWPEARFDVDKQPAHALQVTFPDCTFTVDLVPAFDDLNGSEDVFIADRDLDRWERSNTRTLRRVISERNLATTGVFVHQVRMGKAFKSHQPALEKLCGLVIESLWYAAITKKMPHATAMVTAFENAASAVLGEVRDPTGADDLTKDWTPSERSTFSRTFALAAKRGQEALRLAADGEHQGAIEIWFALFGEPFPAPSAQTAAQTLSALKAGSITSTGRAVTSQRGAQTNRPARSWRTR

SEQ ID NO: 4317 - protein, 338 aa, Planobispora rosea
MDPLTIPAAFGHFDTELNLDPAERAKAMDRHHEITDVLTAAGAAASTFLQGSFARKTMPKPLKDVDMVILLPEGYRLAWFGPGRGGPAAAMARLRREIEKHWPDARFDVDGKPAHALQVTFADCNFTVDLVPAFADVSGGEDVFIADRELDRWERCNTRTLRRLVAERNQVTGGVFVHQVRMGKAFKTSTPTLQELCGLVIESLCYAAITQKMAHATALVTFFEHAATAVMGQVMDPTGADDLAEKWTSSDRETYRQAFATAAAQGREALRLAADGEHEAAIEIWHAVFGDPFPVPAPQTPAQALAALTAGSITSTGRAVTSRRGAQPNRPARSWRTH

SEQ ID NO: 4318 - protein, 338 aa, Kitasatospora mediocidica
MNTTKSAFADLDTALNLDPDERAAAQNRHQAVTTTLRTASLIEATFLQGSFARKTMLKPLKDVDMVIVLHPAVAEEHALTAPGGATRAMNLIRRVVEQAFPGARFDVEDRPAHALQVTFADLDFTFDLVPALNDPGTEDVFIANRESDATTPWERSNTRTLNRVISERNRATGGRFVHQVRMLKQLKKDHPLLDDTCGLLWEAFAYRAVTAATDHSEALAATLAHAAQAVAGPVHDPTGVDDLTAKWTPGQRAGYAQALRTAADQAAEARRLEQDGDHDAAIDIWHTLIGDAFPASPGQTAADALRALASGSITSTGRAVTSQRAQQPARPSRSWRTR

SEQ ID NO: 4319 - protein, 345 aa, Serinicoccus sp.
MTVQTASSTIAEAFDGFDENLKLDAAEREQAIERWKEVRNSLSENNLCTSSFLQGSFGRKTMRKPLKDVDVVVFVSESLVAQAQQDVGTRGSNTAEVVMRYFEDALRATFPGATFEVGAKALTVGFDDVPFTVDLTPALESEERWVRIGNTETGEWELSDTRIIGDRVSTRNQACGGLFVRQVRMARELVAKLRERDPRLEFVKGLTAESLVYMAVKQQVEHADAMLAFLRTAKAAVLGPIYTPSGVDDLTQKHEWTDEHRQLARTAFGTLLNDAEEALVLDQAGDPPAAQWAWAEILGSEFPQPATSELDALRRTQAGSVTRTGITTAAVTTPVKVAPQRAWAP

SEQ ID NO: 4320 - protein, 306 aa, Unknown
  Description of Unknown: bacterium BMS3Bbin04 sequence
MTVNEAFAEFLKRIELNQARATQLSDRYIAIKETIEGSISGADVFQIGSFQRKTKIRPTQDNNNLDIDVGVCLGEFSRYVPGGVYPAEAVETLENSIAPKGSYKKIRPYVDAPTIVLEYADGFKFELVPCYRDKSGKYHRENGPDCYVIPDSNNTWIAADYKYDAAFISGMNQKDQVKQVLVPSIKMIKKFVENNNICISSFHTEAMCAISVPGFISFWESRKQKWHYQHILAAWLDKASEYVLGDVSIPGSYSGQLELEGNMLYRTVISGSLKALSKTAWEICNITNSDQAISAWHKLIGEPFPH

SEQ ID NO: 4321 - protein, 490 aa, Anaeromyxobacter dehalogenans
MPTRERPACSCGRPSVTSRTAVPCHSRRVLSQDARVPRAGGDRMRMAWDHWLSSAWPELISGKRVHVPEWLPPPDWGGMQRAENAWVRAFDDGRTLVVTQAAPNGSKFVAEVWMPTRFEAALRRAKEWASEHPIAAVLVGGILVVAFVVLVAGVARAAERQRIEPEPDGCGPRSLPDPKPAAQATTRSATSADADAARDGISALFTELLASIQPTDADFGRAQSHANSIETALRESFSVNRLSVVGSHSRGTAVRASSDVDYFAVVARDDVRWGDAYTSSETVLKNVRIALQDKFKNTEIRRDLQAVVVRFADGEDPVDVVPAVFLGMSANSRPLYRIPNGKGGWLETSPEGHNKYIHDADKRSGRKLRGTALLLKHWRNCRATAVPIQSFHLELQLAAAGVCRVGMTYAECIAATLERFHVTGCQPIADPLGISGEVPACSTDAKRLAAVDAIRSGLGFATDALASERAGDLVAARRAWRRFFNRAFPA

SEQ ID NO: 4322 - protein, 292 aa, Pedosphaera parvula
MNTVSDALKSLLNRIQPTGGEVQAAAKHFETIKTRLETVFAARKFPKAGSFSRGTFIRGRSDVDVFAQIPLDEVWWGSEWKSSFTILDRFRKEIAARLPSTKVGRDVHAIVVEFWDMDIDVVPAAWGGFSKEYKRPLYYVPDGNGRWMLTSPDIHNGYIALKNQESGGKLRAVAQLFKFWRVCRDPAIPISSFHIEMVLASEGICNGVKSYAECMTELLQRMAERDCAGILDPYRINGNIAATKSEAQRAMALASVKNSRDHAKAALIAERNGKVDEALGQWNYVFNYKLFR

SEQ ID NO: 4323 - protein, 294 aa, Polaromonas sp.
MRSQAPPQLNLIALASRIQPQDAGLRAARSHRMSVRTRLTKSFAVANALAIGSHARETAVHRFSDLDFMVVLRKEEFYHGDRMVSSDTVLNRVIDDLRERYPSSTVKRDILAASLGFGSSGQSLDVVPAKFHEFVGGRPVYLIPDGDGGWLRTSPATHDRQFQVQQTRSGNKLRKVSQLLKWWKHARENPLPIRSFYIDMLLCSGDVGVGVGKTYGTCLKDFFELLVATECRPVLDPCGIAGRISANDSQAQHDTLNRAAVYAHQHAHAAIAAEQRRDFPEANRQWSLVFNEAY

SEQ ID NO: 4324 - protein, 275 aa, Streptomyces turgidiscabies
MQNSMKNSPTKNFHILLDRISLTVPEQEAALNRAESVRENLMNFSLVQECVITGSMARSTAIRTFSDVDIIAIINDDPKMMENSKLAISAISDYLARTYSSIEDFDSAVHITLNDGPGIDVVPAFIAGKNTSGHSLFKIPAEQRSWINYDPAGQDQRIEQLSLQLGDEFKQAIRLAKWWSRANGSPIPSYEIEGVMSRTFLKWTEMPTPPEALATFFREADANKPDKVTGHGKSVIRKAALMAQDALELAAQGDTAGSMERWRCLLGEQFPTVVF

SEQ ID NO: 4325 - protein, 366 aa, Streptomyces sviceus
MVGLTVVDEQPSMLVAVAAPDPGACGRGVHPGWTTRPRRHATMGIDDAFDAFQKTVNEDIDKTRLARERRDLFKAALGGEPDVLETFGSGSLSRSTQLKPIHDVDIIAIYDPDEHPEWGNDGPSAEDALKHIRGQVNRLLSQSSGTHGNVVRHTLLRNHAVKCFLDDPDDPEAFTVDVMAALRQADGSLLIPEKLTTRWVPADPKYLIAQVADHHRDWSHFRPLVRVLKQWRHTAPVEGRIKSLVMEVLALNCMPRSGNRSEGLKTFFTAAAVQVNEGVWDPAGLCGEIQPDLDRAGLSAAFAEAADVAERACAAAAEGDTDDALRLWQAILGEDFPAPAAPAKAATLITAPALITPRPIKDAPQG

SEQ ID NO: 4326 - protein, 324 aa, Streptomyces sviceus
MGIDDAFDAFQKTVNEDIDKTRLARERRDLFKAALGGEPDVLETFGSGSLSRSTQLKPIHDVDIIAIYDPDEHPEWGNDGPSAEDALKHIRGQVNRLLSQSSGTHGNVVRHTLLRNHAVKCFLDDPDDPEAFTVDVMAALRQADGSLLIPEKLTTRWVPADPKYLIAQVADHHRDWSHFRPLVRVLKQWRHTAPVEGRIKSLVMEVLALNCMPRSGNRSEGLKTFFTAAAVQVNEGVWDPAGLCGEIQPDLDRAGLSAAFAEAADVAERACAAAAEGDTDDALRLWQAILGEDFPAPAAPAKAATLITAPALITPRPIKDAPQG

SEQ ID NO: 4327 - protein, 325 aa, Streptomyces neyagawaensis
MGIDDAFDTFQKTVNEDIDKTRLARERRDLFKTALLSEPDILETFGSGSLSRSTQLRPIHDVDVVIVYDSDEHPDWGNDGPSAQDALEHVRTQVNRLLSQTNGTHANEVRHTLLRNHAVKCFLDDTEDPEAFTVDVMAALRQEDGSLLIPEKLNTRWVPADPEYLIDQVADHQRDWPHFRPLVRVLKQWRLTAPVEGRIKSLVMEVLALNCMPRSGNRPQALKTFFTAAAVCVHEGVWDPAGLCGQIQPDLDHAGLSDAFAEAADLAERACVAAAEGDTDNALRLWQKIFGDDFPAPAALAKPASPITGTPALITPRPIKDAPQG

SEQ ID NO: 4328 - protein, 324 aa, Streptomyces sp.
MRIDEAFDALQKTVDEDIEKTRLARGRRDLFKEALLKEPDVLETFGSGSLSRSTQLKPIHDVDIVVVYDPDEHPEWGSSGPSAEEALEHIRSQVNRLLSQSKGTHATVVRHTLLRNHAVKCFLDDPDDPEAFTVDVMTALRQPDNSLLIPEKLSARWVPANPEYLIELVAEHQRSWSYFRPLVRLLKQWRLDAPVEGRVKSLVMEVLALQCLPMSGNRSQGLKTFFTAAATRVNEGVWDPAGLCGEVQPDLDRQGLSAAFANAADLADQACAAAVEGDTDEALRLWQEIFGEDFPAPAPASKTTSLIGAPALITPRPIKDAPQG

SEQ ID NO: 4329 - protein, 325 aa, Streptomyces sp.
MGINEGFDALQKAVDEDIEKTRLARGRRDLFKEALLTEPDVLETFGSGSLSRSTQLKPIHDVDIVVVYDPDEHPDWGSSGPSAEEALEHIRSQVNRLLSQSKGTHATVVRHTLLRNHAVKCFLDDPDDPEAFTVDVMAALRQPDDSLLIPEQLSARWVPANPEYLIDIVAERQRAWSYFRPLVRLLKQWRLDAPVEGRVKSLVMEVLALQCLPTSGNRSQGLKTFFTAAAVRVNEGVWDPAGLCGEIQPDLDRQGLSDAFAEAADLADQACAAAAEGDTDEALRLWQKIFGEDFPAPAAAPKKTSSLIGAPALITARPIKDAPQG

SEQ ID NO: 4330 - protein, 324 aa, Streptomyces sp.
MGIDDAFDDFQKTVNEDLDKTKLARERRDLFKTALLSEPDVLETFGSGSLSRSTQLKPIHDVDIVIVYDGDAHPGWGQFGPSAEDALEHIRTQVNRLLSQSSGTHDNVVRHTLLRNHAVKCFLDDPDDPEAFTVDVMAALRQADGTLLIPEKLSTRWVPANPEYLIDQVAERQRAWPHFRPLVRILKQWRHTVRVEGRIKSLVMEVLALHCMPDSGNRATALKTFFTAAADRVHDGVWDPADLCGEIQPDLDREGLAAAFTEAADLADQACAAAAAGDTDGALRLWQKIFGDGFPAPATPGKAAGAITAPALLTPRPIKDAPQG

SEQ ID NO: 4331 - protein, 324 aa, Streptomyces hygroscopicus
MGIDDAFNDYQKTVNEDLDKTKLARERRDLFKTALLSEPDVLETFGSGSLSRSTQLRPIHDVDIVIVYDGDAHPGWGVSGPSAEEALEHIRTQVNRLLSQSNGTRDNVVRHTLLRNHAVKCFLDDPDDPEAFTVDVMAALRQADGTLLIPEQLNTRWVPANPEYLIDQVAERQRGWPHFRPLVRVLKQWRHTVHVEGRIKSLVMEVLALHCMPDFGNRATALKTFFTAAADRVHEGVWDPAGLCGEIQPDLDREALAAAFTEAADLADQACAAAAAGDTGGALRLWQKIFGDDFPAPAAPGKTAAAITAPALITPRPIKDAPQG

SEQ ID NO: 4332 - protein, 322 aa, Streptomyces prunicolor
MGINDAFDELQAEVNADIDQVKLARERRDTFKKAMSGEEDVLETFGSGSLSRSTQLKPIHDVDIVVVYDVTAHPDWGAPGDSAGEALDHAGDQIHRLLGQTYGTVAQEVRLAVPRNHAVKCFLDDKDEEEAFTVDVMPALRQSDGTLLIPEKLNRCWVPADPEYLIRKVAEHQGAWEHFRPLVRVLKDWRHSAPVQGRIKSLVVEVLALECMPKEGSRAEGLKAFFTAAAVRVNEGVSDPAGLCGEVQPDLDYDGLSDAFADAADLAERACAAAAAGDTDGALRLWQDIFGDGFPAPAKPASKITGTPALVAPRPIKDAPQG

SEQ ID NO: 4333 - protein, 322 aa, Streptomyces xylophagus
MGINDAFDQLQAEVNADIDQVKLARERRDTFKKAMSGEEDVLETFGSGSLSRSTQLKPIHDVDIVVVYHAAAHPDWGAPGDSAGEALDHAGDQIHRLLGQTYGTVAQEVRLAVPRNHAVKCFLDDKDEEEAFTVDVMPALRQSDGTLLIPEKLNRCWVPADPEYLIRKVAEHQGAWEHFRPLVRVLKDWRHSAPVQGRIKSLVVEVLALECMPKEGSRAEGLKTFFTAAAARVNEGVSDPAGLCGEVQPDLDYDGLSDAFADAADLAERACAAAAASDTDGALRLWQDIFGDGFPAPAKPASKITGTPALVAPRPIKDAPQG

SEQ ID NO: 4334 - protein, 323 aa, Micromonospora viridifaciens
MGVNEAFDALQEAVDADRAQVVLARARRDTFKKALEAEGDVVEVFGSGSLRRSTQLKPIHDVDLVVVYAEDDHPDWGLPGDSAEEALDYTRGRVNALLGATNGTVDKLVRLARWRNHAVKCFIDDPDDPEAFTVDTMPALRQADGTLLIPEALSRKWVTADPEDLIRRVAEHQADWAYFRPIVRVLKDWRRSVKVEGKIKSLLIEVLALECMPRSGSRAEALRAFFTAAAVRVNRPIEDPAGHCGLIQPDLDKIGLRAALEEASEIATRACDHAAVGDTDDALRAWQEIFGEDFPAPAKKKVSPAVTGPALILPRPIKDAPQG

SEQ ID NO: 4335 - protein, 323 aa, Micromonospora krabiensis
MGVDEAFDEFQKTVDAERLQVVLARARRDIFKEAFEAESDVAEVFGSGSLRRSTQLKPIHDVDLVVVYAEDDHPDWGQPGDSAEEALDYTRGRVNALLGATNGTIDKLVRLARWRNHAVKCFIDDPDDPEAFTVDTMPALRQADGTLLIPEALSQTWVTADPEDLIRRVASHHADWAYFRPIVRVLKDWRRSVKVEGKIKSLLIEVLALECMPRSGSRAEALRAFFTAAAVRVNTPIEDPAGHCGLIQPDLDKIGLRAALEEASEIATRACEHAAAGDTDDALRAWQEIFGEDFPAPAKKKASPAVTGPALIVPRPIKDAPQG

SEQ ID NO: 4336 - protein, 319 aa, Mycobacterium sp.
MGVDEAFDGYQKTIDADPAHVKLARERRDVFIGALQKADGVKEIVKSGSLERRTQLEPIHDVDLIMVFDGSTVPEWGSPGSSSYEALERAHDEVVARLGLSRGTDSKLVRRADTRDHAVKCFVDPPDDEHPFTVDVMPVIRQADNTLLIPSTNAQEWSTADPEYLIDQVRRHHEDWSFFRPMVRVLKNWRKSVDSETRIKSLVMEVLALQCLPHTGNRPEALREFFTAAAVQVNLGVDDPAGHCGAIQPDLDIVALRDALLDAADLADRACDQAARNDVDGAQRTWQELFGPDFPAPPKKTVPKAPLAPIPLITDSPQG

SEQ ID NO: 4337 - protein, 319 aa, Mycobacterium kansasii
MGVYEAFNAYQQTIDADPAHVELARERRDVFIGALEKVDDVKGIVNSGSLERRTQLEPIHDVDLILVFDTSAVPEWGSPGSSSDYALARAHDEVVARLGLSRGTDSKLVRRADTRDHAVKCFVDPPDDEHPFTVDVMPVIRQADNTLLIPSTKAQEWSTADPEYLIDKVRRHHEEWSFFRPMVRLLKNWRKSVNSETRIKSLVMEVLALQCLPHAGNRPEALRQFFSAAAVQVNLGVEDAAGHCGPIQPDLDIVALRDALLDAADLAGRACDQAARNDVDGAQRTWQELFGPDFPAPPKKTVPNAPIAPVPLITDSPQG

SEQ ID NO: 4338 - protein, 319 aa, Mycobacterium kansasii
MGVYEAFNAYQQTIDADPAHVELARERRDVFIGALEKVDDVKGIVNSGSLERRTQLEPIHDVDLILVFDTSAVPEWGSPGSSSDYALARAHDEVVARLGLSRGTDSKLVRRADTRDHAVKCFVDPPDDEHPFTVDVMPVIRQADNTLLIPSTKAQEWSTADPEYLIDKVRRHHEEWSFFRPMVRLLKNWRKSVNSETRIKSLVMEVLALQCLPHAGNRPEALRQFFSAAAVQVNLGVEDAAGHCGPIQPDLDIVALRDALLDAADLAGRACDQAARTDVDGAQRTWQELFGPDFPAPPKKTVPNAPIAPVPLITDSPQG

SEQ ID NO: 4339 - protein, 329 aa, Nocardia sp.
MPPGVIVNLKTAFDQFQQHVNADPDLVKIARDRKNHFVAGLSGGEGVVDVWLSGSLRRLTQLDPVHDVDLVLEVSPEAYPGWGLPGSSSAEAVEFTRSWVKEQLGDPDGAHAQLVRLARPGNRAVKCFIDDPDEPDAFTVDVMPALRKTDGTLLIPAADDADWINADPEHLIREVGTRQETWDFYVPMIRLIKDWRFQVKDGVAIKSLFMEVLALECLPTGLERPQALSRFFTRAAVRVNQSIEDPAGLCGPIQPDLDITELRDALSRADDLAAAACAAQDNGAEDKAMRLWQEVLGWNFPAPVESKASKIFGAPALVTSGVVRDTPQG

SEQ ID NO: 4340 - protein, 323 aa, Nocardia sp.
MNLKTAFDQFQQHVNADPDLVKIARDRKNHFVAGLSGGEGVVDVWLSGSLRRLTQLDPVHDVDLVLEVSPEAYPGWGLPGSSSAEAVEFTRSWVKEQLGDPDGAHAQLVRLARPGNRAVKCFIDDPDEPDAFTVDVMPALRKTDGTLLIPAADDADWINADPEHLIREVGTRQETWDFYVPMIRLIKDWRFQVKDGVAIKSLFMEVLALECLPTGLERPQALSRFFTRAAVRVNQSIEDPAGLCGPIQPDLDITELRDALSRADDLAAAACAAQDNGAEDKAMRLWQEVLGWNFPAPVESKASKIFGAPALVTSGVVRDTPQG

SEQ ID NO: 4341 - protein, 303 aa, Saccharothrix sp.
MVKVARERAATFKAAFESEPDVRKAWLSGSLRRSTQLDPVHDVDMVIEYDLVDHPDWGQPGPSAGEAVEHARTRCKALLGDPDGTFAELVRRADGRNRAAKCFVDDPDDPEAFTVDVMPVIRQSADALHIPDVEASCWITANPEYLIECAQRRHENWGHYRHMVRVLKAWRLSVTGTVKIRSLVMEVLAWEYLPDGSTRADALATFFEAAATQVNLPIEDPAGLCGPIQPDLDVGALRTALEEAADIAASAQVAARRGDTDEALVLWGRVLGPEFPAPALKSRTTSTASAALSTLSMINRPQG

SEQ ID NO: 4342 - protein, 322 aa, Saccharothrix sp.
MDIEAAFDEYQRAVDADAELVKVARERAATFKAAFESEPDVRKAWLSGSLRRSTQLDPVHDVDMVIEYDLVDHPDWGQPGPSAGEAVEHARTRCKALLGDPDGTFAELVRRADGRNRAAKCFVDDPDDPEAFTVDVMPVIRQSADALHIPDVEASCWITANPEYLIECAQRRHENWGHYRHMVRVLKAWRLSVTGTVKIRSLVMEVLAWEYLPDGSTRADALATFFEAAATQVNLPIEDPAGLCGPIQPDLDVGALRTALEEAADIAASAQVAARRGDTDEALVLWGRVLGPEFPAPALKSRTTSTASAALSTLSMINRPQG

SEQ ID NO: 4343 - protein, 318 aa, Unknown
  Description of Unknown: Microbacterium sequence
MTVLESFATLQSVVDADVKVVQIARDRRDTFTSALLTAPDVKVVWGSGSLARSTQLQPVHDVDLVVEFDQDEHPDWGEDGGSAEEAIERCHDLVNDLLSVSHGSRAQLVRLIRTADRNRAAKCFVDPPEQDNAFTVDVMPALRRPDGILIPFKKEERWSLADPEYLINEVARRQQDWSLFRPLVRVLKYWSRQHEDVTGTVKSLVMEVLALDCLSVSNNRPEALKNFFVNASTHSLRVEDPAELSGLIQPSLDVAGLRRSLEDAAADAVAALRAVASNDQPAATRHWQSVFGTAFPLVLPPGGAGETGPRPVRDSPQG

SEQ ID NO: 4344 - protein, 317 aa, Propionicicella superfundia
MTVLDSFDSLQRELDAAVEVVRVARQRRDTFKAALATAPDVKVVWGSGSLARSTQLQPVHDVDLVIEFDPDQHPEWGQDGDSAEEAIERCRDLVHELLSVESGTYAHLVRQVNTAGRNRAAKCFIDPPDADNAFTVDVMPALRRTDGILIAFKSERRWMLADPEYLIDQVADRQREWAQFRPLVRMLKYWARQHTTETGRVKSLVMEVLALDCLHEGNRPEAIKNFFVEASTHSLQVEDPARLSGAIQPDLDIAGLRRALEDSALAATAAVRAVANNNQAGATGHWQDVFGDAFPLVLPPAGEPDPGPRPIRNSPQG

SEQ ID NO: 4345 - protein, 317 aa, Microbacterium sp.
MAVLDSFDSLQAEIDADVEIVQLARERRDVFKTALSTAPDVKLVWGSGSLARSTQLQPVHDVDLVVEFDPDQHPEWGQPGKSAEDAIERCRDLVHELLSSESGSHAQLVRQVNTANRNRAAKCFIDPPGSDDAFTVDVMPALRRSDGILIPFKSEERWSLADPEYLINEVAARQREWPQFRPLVRVLKYWARQHKQDTGRVKSLVMEVLALECLSQANRPEALKNFFIEASNHDLVIEDPAELSGLIQPDLDTAGLRRALEDSAASASAAVKAVANNDQPTATRLWQSIFGEAFPLVLPPTGEPDPGPRPIKDSPQG

SEQ ID NO: 4346 - protein, 314 aa, Arthrobacter sp.
MGVSTSFDELQADVDADVAVVKLARERRDAFKAALDSAPDVISVWGSGSLRRSTQLQPVHDVDLVVEFDPQFYPDWGEEGASSSDAIERCRELVTELLGVTAGTHERLVRQVNTANRNRAAKCFIDDPDDPDAFTVDVMPALRQRDGILIPFKSEARWTLADPEYLINRVSERQTAWNRFRPMVRVLKYWARQQPFKVKSLVMEVLALECLPDSGNRAAALSGFFAAASRHSLSVVDPAGLSGAIQPSLDSAALRRALEDAALSAASALRAAADGNQAEATRLWRSVLGPAFPVVAATGGAATGPRQVKDSPQG

SEQ ID NO: 4347 - protein, 321 aa, Mycobacterium vulneris
MTIDSAFDSYQRAVNADPEQVSLARARRDSFKKAFAAEPDIVEVLGSGSLARSTQLAPVHDVDLIAVYDTAEHKDWGQAGESSERALRHVQTKVIELLGMSGSVDQLVRETRAAGRNRSVKCFIDPPDAEDAFTVDVMPVLRLPAGTLLVPSARSRRWDEADPEYLISEVAGKQEQWQHFRGVVRMLKSWRLDQSPTIKSLVMEVLALKCLPVDGNRATALRDFFAAAAVEVFYGVEDPAGFCGPIQPDMDVAAVSSCLSTASDYARYACTAAESGDTNTAKYWWRQVFGNEFPGPGALSSVPVVVPTVAAPRPVRDAPQG

SEQ ID NO: 4348 - protein, 321 aa, Unknown
  Description of Unknown: Mycobacterium sequence
MSMESAFDSFQQSVNADPEQVRLARARRDTFKQAFASEGDVTEVFGSGSLARSTQLAPVHDVDLVVVYKAAEHDDWGRAGQSAEDALRHVQSKVTSLLGANGTVSQLVRETRVAGRNRSVKCFIDPPDDDAAFTVDVMPVLRTEAGILLVPGARDKRWDEANPEYLIEAVAAKQQEWPHFRGVVRMLKSWRLDQKPAIKSLVMEVLALKCLQVGQNRPTALRDFFAAAAVEVFYGVEDPAGYCGPIQTDLDVEAVSSCLSVAHDYARYACTAAESGDANTAKYWWRQVFGTDFPGPAEASPAPPIAPPIDTPRPVRDAPQG

SEQ ID NO: 4349 - protein, 324 aa, Amycolatopsis thermoflava
MSLGAAFDAFQKQVDADSTQVKEARERRETFKSALGAESDVVEVWGSGSLRRSTHIGPKIHDLDLVVVFDLDEHPGWGEPGDSAADALDVLGGKVNKLLGATNGTVEKLVRIASPRNHAVKCFIDLPDDDDGFTVDAMPALKYNGALLIPEKNSSNWISANPQYLVEEVKKRNADWDYFLRMVRVLKAWRKRAEVEGKVKSLVMEVLALHYLPGGFSRPEALKRFFTAAATAVGNGPVMDPAGLCGEIQPKLDRIGLCESLLNAADLADQACDAADEGHTDDARKLWREVFGADFPAPQGKPKTSPALIVPAVAPRPIKDAPQG

SEQ ID NO: 4350 - protein, 326 aa, Amycolatopsis coloradensis
MSLTEAFDEYQKTVDADPTQVKEARDRRDTFKVALGAEADVVEVWGSGSLRRSTHTGPLIHDVDLVVVFDRDDHPGWGEPGNNTAADSLDVLHDKITKLLGNSGTVEKLVRRADPRRHAVKCFIDLPGAPEGFTVDAMPALDDNGALLIPEKTDGDTSLWVPSNPQYLVREIAQRSADWDYFLRLVRVVKKWRKRAEVEGKVKSLVMEVLALHHLPVDTRPNALRRFFTAAATAVGNGPVTDPADVCGEIQPDLDRVGLRESLLDAADLADQACDAAANGYTDDAKKLWRDVFGSDFPAPKGKATTGPVLIVPAVTKRPIKDAPQG

SEQ ID NO: 4351 - protein, 325 aa, Nocardioidaceae bacterium
MNVSDAFGRYQSHVDADPASVTEGRRRGNLFKSAFEGLDDVQEVFISGSLARKTHKKPINDVDVVIVFNRDAHLDWGQPGTSAGDALQYTGAKVNELLGATNGAHDQLVRLARPGNHAVKCFVDDPEDPDRFTVDAMPAFRTETGLLIPEKTSTDWVPADPEYLIGQVAARSADWAKYLGTVRMLKTWGASRPGIEIKSLVMEVLALQFLPHDGTTQPIAIKEFFVRAANYIEEGYEVTDPAGICGPVQSSLDYDKFAECLREAATRAGVACSRQAVSDDAAAIRLWGEVFGDGFPPPTNAPGKPGIIPPVVPEKPRPVKDTPQG

SEQ ID NO: 4352 - protein, 325 aa, Nocardioidaceae bacterium; identical to SEQ ID NO: 4351

SEQ ID NO: 4353 - protein, 253 aa, Salmonella enterica
MSVDSAFAEYQKKVNADEDQVAEARRRRDLFKSAFSDEDDIEEVRPSGSLARGTEKDPIHDVDTILVFKAGSHPGWGEAGDSAEEALNHVQTRVRELLGTHGTHAAGEVRRSTWRNHAVKCFMDDKDDADAFTVDAMPALLDGDRLLIPEFTSRKWVPADPQYLIDAIKAKHEQWSKFAGTVRMLKAWGKTQDTEVKSLVMEVLALQHLTTGNTRPIALRNFFTTAAYTLEGGERVTDPAEVCGEIQKDLDYT

SEQ ID NO: 4354 - protein, 321 aa, Rhodococcus triatomae
MSVTDAFKTFQDVVNADITHVREARTRRDLFKDAFDTQDDVQEVVASGSLARGTHKDPIHDVDVIIVFDQDKHPEWGTPGDSAEDALDYTRARVNALLGATNGTYANAVRLARWRNHAVKCFLDDPDDPDAFTVDAMPALRRDGKLLIPEALSDDWVSCDPELLIAEVAKRHAEWNKFAGTVRMLKWWAAAQDTKIKSLVMEVLALDFLPIDANQPAAIKNFFVSACYHIEGGNEVADPAGLCGPIQPDIDSDEFAECLRSARDNAIKAFQAQTNNDTAAAIKYWGEVFGDDFPKPPSSTVGPAPAVVPAAPRPVKDTPQG

SEQ ID NO: 4355 - protein, 321 aa, Pseudarthrobacter phenanthrenivorans
MSVTDAFKTFQDVVNADIAHVREARTRRDLFKDAFGAEVDVKEVIASGSLARGTHKDPIHDVDVIVVFDQEEHPEWGTPGGSAADALDYTRGRVNALLGATNGTYDHAVRVARWRNHAVKCFLDDPDDPDAFTVDAMPALRRDGRLLIPEALSEDWVACDPEFLIAEVADRHAQWNKFAGTVRMLKWWAAEQDTKIKSLVMEVLALDFLPTDVNQPAAIKQFFVSACYHIEGGNEVADPAGLCGPIQPDIDYDEFVDSLRSARDNAIRAFRAQVNNDTAAAIKHWGEVFGDDFPKPPASTGNPAPAVVPAAPRPVKDTPQG

SEQ ID NO: 4356 - protein, 321 aa, Gordonia sp.
MSVTDAFKTFQDVVNADITHVREARTRRDLFKGAFGAEDDVEEVIPSGSLARGTHKDPIHDVDVIIVFDQDDHPGWGTPGSSAADALDYTRERVNTLLGATNGTYDQVVRLARWRNHAVKCFLDDPDDPDAFTVDAMPALRRDGQLLIPEALSEDWVTCDPEFLIAEVADRHAQWNKFAGTVRMLKWWAAEQDTKIKSLVMEVLALDFLPTDVNQPAAIKQFFVSACYHVEGGNDVTDPADLCGPIQPDIDDDAFADALRSARDNAIKAFQAQANNDTPAGIKHWGEVFGDDFPKPPASTSNPAPAVVPAAPRPVKDTPQG

SEQ ID NO: 4357 - protein, 321 aa, Rhodococcus sp.
MSVTDAFETFQDVVNADITHVREARTRRDLFKGAFGAEDDVEEVVASGSLARGTHKDPIHDVDVIVVFDQDEHPEWGSPGSSAADALDHTRERVNTLLGATNGSYDLAVRLARWRNHAVKCFLDDPDDPDAFTVDAMPALRRDGRLLIPEALSEQWVACDPEFLIAEVAHRHAQWNKFAGTVRMLKWWAAEQDTKIKSLVMEVLALDFLPTDVNQPAAIKQFFVSACYHIEGGNEVADPAGLCGPIQPDVDYYAFADALRSARDNAIMAFQAQANNDTATALKHWRAVFGDDFPKTPASTGNLAPAVVPAAPRPVKDTPQG

SEQ ID NO: 4358 - protein, 320 aa, Arthrobacter sp.
MSVTNAFNEFQGIVNADVQQVKEARSRRDLFKGAFILESDVDEVISSGSLARGTHKDPIHDVDVVIVYDGAKHPDWGGPGSSAEDALNHTRSRVNALLGATNGTFDKAVRLAKWRNHAVKCFLDDPDDPNAFTVDAMPALRRNGMLLIPEAASKDWVPCNPEYLIKAVADKHAEWSSYAGTVRMLKWWASEQDIKIKSLVMEVLALHLLPANHIRPVAIKQFFVSAAYAIEGGNEVVDPAGICGPIQSDLDYEGLADSLNAARDAAIRAFQAQNNNNTPAAIQYWREVFGDDFPKPPATGNPLAAVAPALPRTVKDTPQG

SEQ ID NO: 4359 - protein, 320 aa, Arthrobacter sp.
MSVTDAFNEFQGIVNADVQQVKEARSRRDLFKDAFILESDVDEVISSGSLARGTHKDPIHDVDVVIVYDGAKHPDWGGPGSSAEDALHHTRSRVNSLLGATNGTFDKAVRLAKWRNHAVKCFLDDPDDPNAFTVDAMPALRRNGMLLIPEAASKDWVPCDPEYLIKAVADKHAEWSSYAGTVRMLKWWASEQDIKIKSLVMEVLALHFLPTNHIRPVAIKQFFVSALYAIEGGNEVVDPAGICGPIQSDLDYEGLADSLRAARDAAIRAFQAQNNNNTAAAIQYWGEVFGDDFAKPPATGNPLPAVALALPRTVKDTPQG

SEQ ID NO: 4360 - protein, 321 aa, Nocardia mikamii
MSVATAFAAFQQTVNADIEAVREARARRDLFKKAFRPEPDILEVVPSGSLARGTHKDPIHDVDVVLIFDPAKHPGWGVPGQSATDCLDYTRTRVNTLLGATNGTVATAVRLARWRNHAVKCFLDDPEDPDAFTVDAMPAFRRDGMLFVPEATSEKWIYCHPEYLIAETAARHAEWNKFAGTVRMLKKWAADQDIKIKSLVMEVLALQHLPLGSTQSAAVKQFFVSASYFIDGGSEVTDPANICGPIQSDLDYSEFADRLADARDNAVAAAQAQANNDANLAILHWGAVFGSDFPAPTTSDGSPLPAAVPVGPRPVKDTPQG

SEQ ID NO: 4361 - protein, 321 aa, Nocardia xishanensis
MSVATAFAAFQQIVNADIEDVREARARRDLFKKAFLPEPDILEVVPSGSLARGTHKEPIHDVDVILIFDPVKHPGWGEPGQSAADALDYTRARVNALLGTTNGTVETAVRLARWRNHAVKCFIDAPNDPNEFTVDAMPAFRRDGMLFIPEAKSEEWVYCHPEYLIAETAARHAEWNKFAGTVRMLKKWAADQDIKIKSLVMEVLALQHLPLASTQSAAVKQFFVSASYFIDGGSEVTDPANICGPIQSDLDYSEFAARLADARDNAVAAAQAQGNNDANSAILHWGAVFGSDFPAPTASDGSPLPAAAPVGPRPVKDTPQG

SEQ ID NO: 4362 - protein, 321 aa, Nocardia puris
MSVATAFAAFQQTVNADIKHVREARDRRDLFKKAFLPEPDILEVIPSGSLARGTHKDPIHDVDVILIFDPAEHPSWGVPGQSAADCLDYTRTRVNELLGATNGTVATAVRLARWRNHAVKCFLDDHEDPDAFTVDAMPAFRRDGMLYVPEATSKKWIYCHPEYLIAETAARHAKWNKFAGTVRMLKKWAADQDIKIKSLVMEVLALHHLPLKSTQSAAVKQFFVTASYFIDGGNEVTDPANICGPIQSDLDYSEFAARLADARDNAVAAAQSQGNNDAHSAILHWGAVFGSDFPAPTASDGSPLPAAVPAGPRPVKDTPQG

SEQ ID NO: 4363 - protein, 317 aa, Mycobacterium austroafricanum
MSVNDAFRTFQDVVNADIAVVREARGRRDLFRDAFKPLTDVDEIIPSGSLARGTQKDPIRDVDVIIVFAGGEHPDWGEQGASAKDALDYTREQVHDLLGATDGTHAQEVRLARWRNHAVKCFLDDPNDPDAFTVDAMPALRRDGKLLIPQAASEEWINANPEYLIAEVAAKHAAWNKFAGSVRMLKWWAAEQNIKIKSLVMEVLALQFLPITSSQPSAITQFFVSAAYHIEGGGEVVDPAGLCGPVQSDLDFDQFADCLSNARDSAAKASQAQVNNDTNFAIYHWGTVFGDEFPRPATTPISVVAPPPRPVKDTPQG

SEQ ID NO: 4364 - protein, 317 aa, Mycobacterium chimaera
MSVNDAFKTFQDVVNADITVVREARARRDLFKEAFGLLPDVKEVIPSGSLARGTQKDPIRDVDVILIFNDDYHPDWGEPGASAKDALDYTRERVHDLLGATDGTHAQEVRLARWRNHAVKCFLDDPDDPDAFTVDAMPALRRDGKLLIPQAVSKEWICANPEYLITEVARKHAAWNKFAGSVRMLKWWAADQDIKIKSLVMEVLALQFLPTDSSQPAAIAQFLVSAAYHIEGGSEVVDPAQLCGPIQSDLDYDELADRLATARDSAAKAIQAQINNDANAAIHHWGTVFGDDFPRPTKSSPVVVPPPPRPVKDTPQG

SEQ ID NO: 4365 - protein, 320 aa, Unknown
  Description of Unknown: Microbacterium sequence
MSVHEAFRTFQTKVNADVETVREARRRRDVFRAAFGNEADVVEVVPSGSLARGTQKDPIHDVDLVIVYDGAAHTEWGKAGESARDALDHVRGRVNTLLGATNGTHDQIVRLARWRNHAVKCFLDDPEDPAAFTVDAMPALRSGDHLLIPEALSDTWIECDPESLITAVADRHAQWDKFAGTVRILKRWASDQDIKIKSLVMEVLALEHLPTGLNQRAAVRQFFVAAAYAIDGHEVVTDPAGYCGPIQSDLDYVEFAERLKGARDHANQAMQASVNNDTDGALWHWGQVFGPDFPHDPNPASKPAPAVAPVPRQVKDTPQG

SEQ ID NO: 4366 - protein, 320 aa, Microbacterium oleivorans
MSVHEAFRTFQTKVNADVETVREARRRRDVFRAAFGNEADVVEVVPSGSLARGTQKDPIHDVDLVIVYDGAAHTEWGKAGESARDALDHVRGRVNTLLGATNGTHDQIVRLARWRNHAVKCFLDDPEDPAAFTVDAMPALRSGDHLLIPEALSDTWIECDPESLITAVADRHAQWDKFAGTVRILKRWASDQDIKIKSLVMEVLALEHLPTGLNQPAAVRQFFVAAAYAIDGHEVVTDPAGYCGPIQSDLDYVEFAERLKGARDHANQAMQASVNNDTDGALWHWGQVFGPDFPHDPNPASKPAPAVAPVPRQVKDTPQG

SEQ ID NO: 4367 - protein, 338 aa, Nocardioides sp.
MSSVNGSFDDYQAHVNAEDAQVVEARRRRDLFKTSFEKRVDVKEVIASGSLRRGTHRDPINDVDTIIVYDGNEHPDWGQPGDSAAAALDHTRALVNEMLGATNGTDAQEVRLAKPRNHAVKCFLDDPDDDNAFTVDAMPALRREGKLLVPEALSKEWIYTDPEELIEQVAKKHAEWNRFAGLVRMLKDWGSKQDIKIKSLVMEILALDHMPNGNNRPTALKAFFVAAAYRVECLIEIDDPAGLCGAIQPDLDMNELGKRLRTAADLASEAVAAQSNNDTHKALTKWREIFGDGFPKPPSPPPSKPAGPNPAPGVLPFAPGTEPDTTPKRRPIKDSPQG

SEQ ID NO: 4368 - protein, 325 aa, Nitriliruptor alkaliphilus
MTPNTAFDTFQTSVNATPEQLAEARRRRDVVLASMSSQTDTETDDCFVSGSLARGTQRGLIHDVDIVVVYRSDDHPTWGSPGASAEQALEHARGQVKYALGTDGDDGTEIRHTLLRNHSVKCFLDDPDEPKAFTVDLVPALRQDNGRLWVPERLTSTWIESDPQYLIREVARRHSEWDRFVPLVRLLKHWNAGADSQMKNLAVEILALQHLPAADTRQDGLQRFFTAAAANIMYGIEDPAGVCGVIQPDLDLTATKNLLDAAATTAWDAYMLGLDGDDDHAVCKWRELFGPDFPEPPGGCDSGGNNGWPTIIVPTPRRVADAPQG

SEQ ID NO: 4369 - protein, 376 aa, Sinomonas atrocyanea
MLRVELGAGESHHLSNPARKNAAMTVISPTITLEHLANEARSRIEVSAEELDEARERRSAVGAALRREFTGSRTYLNGSIAHGDALTPLTDVDLGVVIPDPDHEYGPGKRGPKALKERAAEAIRHGLKGRYGDLAVEVEGRKRSLLVRFRDPVAPGRPDFTADVIVALDNPGGAGLYIPRFDSWDRSHPEKHTELISIANKATQARFARTVRLLKHWNRSNGKLLCSWNIKALALDCIVAPTALIPGLRGWFDHAIAQLSRGETPDPAGVAAKPIKLNGTRTEAIRRLTRALENLDRAIEYEQAGYPVLAHDELAKFFNDPEVMPRPSATAVMGEEARRVLDEKSKDSKSFGAPALLTGTGSSAGRSRGNIRSWGA

SEQ ID NO: 4370 - protein, 353 aa, Sinomonas atrocyanea
MTVISPTITLEHLANEARSRIEVSAEELDEARERRSAVGAALRREFTGSRTYLNGSIAHGDALTPLTDVDLGVVIPDPDHEYGPGKRGPKALKERAAEAIRHGLKGRYGDLAVEVEGRKRSLLVRFRDPVAPGRPDFTADVIVALDNPGGAGLYIPRFDSWDRSHPEKHTELISIANKATQARFARTVRLLKHWNRSNGKLLCSWNIKALALDCIVAPTALIPGLRGWFDHAIAQLSRGETPDPAGVAAKPIKLNGTRTEAIRRLTRALENLDRAIEYEQAGYPVLAHDELAKFFNDPEVMPRPSATAVMGEEARRVLDEKSKDSKSFGAPALLTGTGSSAGRSRGNIRSWGA

SEQ ID NO: 4371 - protein, 353 aa, Micrococcus sp.
MTTISPTITLEQIVSQARRRIEVSDAELDEARKRRGAISTALRDEFPGSRTYVNGSIAHGDALTPLTDVDLGVVVPDSDHEYGPGKRGPKDLKERAADAIRAGLKEEYGDLAVEVKGRKRSILVRFRDPVAPGQPDFTADVIIAIDNPDGAGLYIPGFDSWDRSHPEKHTELVSIANTITDACFARIVRLLKHWNRSNGKPLCSWNIKALALNCVDAPTALLPGLRAWFDFAIKELSRGETPDPASVAEKPIKLNDTRTEVIRRLTRALEKLDRAIEYEKTGYTVLAHNEIAKFFNDPEMLPAPDPTAVMQEEARRITAQKAKDTKTFGAPALLTGTGASAGRERGNVRSWGA

SEQ ID NO: 4372 - protein, 353 aa, Arthrobacter sp.
MTTISPTITLEQIVNDARRRIEVSDPELEEARKRRSAIGAALRNEFIASRTYVNGSIAHGDALTPLADVDLGVVVPDPDKEYGPGKRGPKDLKERAADAIRAGLKEEYGDLAVEVKGRKRSILVRFRDPVAPGQPDFTADVIVAIDNPDGAGLYIPRFDTWDRSHPEKHTELVNTANKITEARFARVVRLLKHWNRSNSKPMCSWNIKALALDCIIAPTALIPGLHAWFDHAIEQLSRGETPDPAGVATNPIKLNATRTEVIRRLTRALEKLDRAIEYEKDGYIVLAHNELAKFFNDPEMMPAPDPVAVMEEEALRITAQKTKDTKTFGSPALLTGTGASAGRVRGNVRSWGA

SEQ ID NO: 4373 - protein, 352 aa, Kocuria rhizophila
MTSTITLEQILTEARHRIEVSDPELAEARKRRSALASALRTEFPGARTYVNGSIAHGDALTPLTDVDLGVVVPDPDNAYGPGKQGPKQLKDRAAKAIRTGLKEDYGDLAVEVEGRKRSILVRFRNPVAPGQPDFTADVIVAIDNPDARGLYIPRFQSWDRAHPERHTGLVLTANQTTKSTFARVVRLIKHWNRRNSKPLCSWNIKALALDCITTPTTLLPAMREWFRYAIEQLSISETPDPARVAKNPIKLNEKMTRTEVVRRLTRSLERLDRAIEFEAAGYPVLAHDELAKLFNDPDMLPAPSPVAVLHEEARRVTDQKKKDTQVYGTPALLTGTGVAAGTERNNVRSWGI

SEQ ID NO: 4374 - protein, 352 aa, Kocuria sp.
MTSTITLEQILTEARHRIEVSDPELAEARKRRSALASALRTEFPGARTYVNGSIAHGDALTPLTDVDLGVVVPDPDNAYGPGKQGPKQLKDRAAKAIRTGLKEDYGDLAVEVEGRKRSILVRFRNPVAPGQPDFTADVIVAIDNPDARGLYIPRFQSWDRAHPERHTGLVLTANQTTKSTFARVVRLIKHWNRRNSKPLCSWNIKALALDCITTPTTLLPAMREWFRYAIEQLSISETPDPARVAKNPIKLNEQMTRTEVVRRLTRSLERLDRAIEFEAAGYPVLAHDELAKLFNDPDMLPAPSPVAVLHEEARRVTDQKKKDTQVYGTPALLTGTGVAAGTERNNVRSWGI

SEQ ID NO: 4375 - protein, 353 aa, Leifsonia sp.
METPTQKDDLESVLDQARRRIEVRDEELLEARKRRDAVAASLRAEFAGSRTYVNGSIAHGDALTPLTDVDLGVVVPDPDHIYGPYKTGPSVLQERAAAATRRDLKEAYGDIAVELKGRKRSILVRFRDPVTPGQPDFTADVIVAIDNPAGAGLFIPRFNGWDRSDPETHTRLVRAAVKGTNTSYARVVRLVKHWNRTHDKPLCSWNIKALALGCITSPVELIEGLRIWFEYAADELNLGETEDPAGVAPHPIKISEKWNRTEVVRELRRALQILKFAIQLESDGYELLAQDELAKLFKDESMLPHPPQAAVRLEQARRTMAERHGQSKQFGAPALITSTASPRDRVNAQSWSA

SEQ ID NO: 4376 - protein, 367 aa, Micrococcales bacterium
MTSEATDRRTPGREVATMTIIDPPIQKTSTVETALLAARTRIEVKREELTEAEQRRSDLAVVLRAEFKGSRTYINGSIAHRDALNPLSDVDLGVVVPDPEGKYGPGKKGPSELQERAANAIQQLRSKYPDLRVEYKGRKRSILVRFGDPVTPGQPDFTADVIVAIDNPTGAGLYIPSYDRWDRSHPEKHTELVQQANAATKKSFSQGTRLMKHWNRKHDRPICSWNIKALALAVILRPISMTDYIRTWLDYAIDELDKGETQDPACVAGPIKMNKTKTEVLQYLRDGRDIFKRALQLEAEGYPILALNELAKFFRDEEVMPRPNQDDVRAMEAQRIKSMNFGAPASAATSASTTSLGERINTRSWSC

SEQ ID NO: 4377 - protein, 353 aa, Microbacterium sp.
MTLLDIPNRTSISTVEDALNEARTRIQVTPEELAEARRRRDALAAALKHEFGGRTYVNGSIAHGDALNPLTDVDLGIVIPDPDGLYGPGLRGPGALQERAADAIRRELKDEYPKLRVEHLNRRRSILVRFGDPVTPGQADFTADVITAIDNRTGAGLYIPNYRTWDRSHPERHTEMVKQANAVTRSTFARGTRLMKHWNRKHDRPICSWNIKALALGCITGPVTMTSYISTWLNHAIAQLSIGETPDPAGVAGPIKINEMFTRLQVVAAFRQAKADFDLALQYEREGYPILALNQLAIFFGDEAVMPKPDQDEVKRVARERWREKNPSLVPAPAAPASTSAYGDRLPVRSWAC

SEQ ID NO: 4378 - protein, 359 aa, Rhodococcus fascians
MYQSIPATNEIALMRSGSKKTLLQVLKDARERIQVSDDELDEARRRRDLLAATLKAEFGPDSRTYVNGSIAHGDALTPLTDIDLGIVVPNSDGSYGPYGKGPAELQERAAAAIRTAHKEEFPNLRVYVGGRKRSVYVSFGEPVDPDVEDFSADVIVALDCWTGSGLWIPHYDSWDRSDPESHTNLVRDVAKSSAYNYSRTVRLLKHWARRHSKPLCSWNIKALGLDSLMDSMNQLDGMLAWFEYAIADLSWRETPDPADVAGPISIPGDRSELVMKLSKARDKLADAISFEKDGYDVLAVKALASFFNDKDMLPPPETKAVTAQQLQRTADMRAARTSRVTVGDRPQTRNRTPTRSWAP

SEQ ID NO: 4379 - protein, 346 aa, Rhodococcus fascians
MRSGSKKTLLQVLKDARERIQVSDDELDEARRRRDLLAATLKAEFGPDSRTYVNGSIAHGDALTPLTDIDLGIVVPNSDGSYGPYGKGPAELQERAAAAIRTAHKEEFPNLRVYVGGRKRSVYVSFGEPVDPDVEDFSADVIVALDCWTGSGLWIPHYDSWDRSDPESHTNLVRDVAKSSAYNYSRTVRLLKHWARRHSKPLCSWNIKALGLDSLMDSMNQLDGMLAWFEYAIADLSWRETPDPADVAGPISIPGDRSELVMKLSKARDKLADAISFEKDGYDVLAVKALASFFNDKDMLPPPETKAVTAQQLQRTADMRAARTSRVTVGDRPQTRNRTPTRSWAP

SEQ ID NO: 4380 - protein, 359 aa, Rhodococcus fascians
MYQSTPKTDGIALARSDSEKTLLQVLKEARQRIQVNDDELDEARRRRDLLAATLKAEFGTDSRTYVNGSIAHGDALTPLTDIDLGIVVPNSDGSYGPYGKGPAELQERVAVAIRTAHKEEFPNLRIYVGGRKRSVYVSFGDPVDPDVSDFSADVIVALDCWTGSGLWIPHYDTWDRSDPEAHTDLVRDAAKSSAYNYSRTVRLLKHWARRHSKPLCSWNIKALGLESLTESMNQLDGMLAWFESAIGDLSWRETPDPADVAGAISIPGDRSELVAKLSKARDKLTDAISFERDGYHVLAVEALASFFNDKDMLPPPEIKAVTAQQLQRTADMRAARTSRVTVGDRPQTRNRTPTRSWAP

SEQ ID NO: 4381 - protein, 359 aa, Rhodococcus sp.
MHQSIPATNEIALVRSGSKRTLLQVLKDARERIQVNDDELDEARRRRDLLAGTLKSEFGADSRTYVNGSIAHGDALTPLTDIDLGVVVPNSDGSYGPYGRGPAELQERAAAAIRTAHKEEFPNLRVFVGGRKRSVYVSFGDPVDPNVADFSADVIVALDCWTGSGLWIPHYDNWDRSDPESHTGLVRDAAKRSEYNYSRTVRLLKHWARRHSKPLCSWNIKALGLDSLTDSMNQLDGMLAWFDYAIGDLSWRETPDPADVAGAISIPGDRAELVTKLSKARDKLADAISFEKDGYHVLAVEALASFFNDKDMLPPPETKAVTAQQLQRTADMRAARTSRVTVGDRPQTRNRTPTRSWAP

SEQ ID NO: 4382 - protein, 359 aa, Rhodococcus sp.
MYQYTSATDGIELASSSSKQTLLQVLQEARERIQVNDDELDEARRRRDLLAGTLKAEFGADSRTYVNGSIAHGDALTPLTDIDLGIVIPNPDGVYGPLGKGPAELQNRAAAAIRAAHKSEFPNLRVYVNGRKRSVYVSFGDPVDPDVTDFSADVIVALDDGTGAGLWIPHYDTWDRSAPETHTTLVRAAAKSSGYNYSRTVRLLKHWSRRHSKPLCSWNVKALGLDSLADSMNQLEGMLAWFDHAIDDLTWRDTPDPANVAGAIGVPGDRSELVDKLRKAQDKLVEAITHEKDGYNVLAVEALSSFFNDKDMLPPPEAKEVTAQQLKRTADMRAARPSRLSVGDRPQTRSRTPTRSWAP

SEQ ID NO: 4383 - protein, 349 aa, Unknown
  Description of Unknown: Gordonia sequence
MAAPDLTTSRRLADVLREARQRIQVSDDELAEARRRRDLLASTLRREFGRTSRTYLNGSVAHGDALTPLTDIDLGVVVPDPESTYGPHGQGPEVLQLRAADAIRSAHKTEFPNLRVIVGGRKRSVYVSFGSPVDPSQDDFSADVIVALDYPTGAGLWIPNYDSWDRSDPETHTTLVRSAAKSSAYNYSRTVRLLKHWARTHSKPLCSWNIKALALACLAVELDQLDGMVAWFDHAIDDLSWRDTPDPAGVAGAIALPGDRTELVAKLQKARAKLAEAIQYDAEGYDVLAIEALAIFFNDEQMLSRPPAAAIAEQHLQRTAQNRRQRSVPTAPALSPQVRDRTPVRSWAR

SEQ ID NO: 4384 - protein, 343 aa, Nakamurella panacisegetis
MTALSGIAALLKVLSAARERIQVDDAELTEARRRRGRIQTALKEEFGPDCRVYLNGSVAHGDALTPLTDIDLGVVVPNPDGEFGPYANGPAKLQDRAANAIRDALKGEFPLLRVITGGRKRSVYVAFGAPVDPNESDFSADVIVAIDYPWGNGLWIPNYETWDRSDPEAHTRLVRDAIKLSNVNYTRTVRLLKHWVRRHSKLLCSWNIKALGLSCITGELNQLDGMVAWFDYAIADLSRRETPDPAGVAGPISIPGDRAEVVGRLTTARAKLVEAINYANDGYDVLAVDALAVFFNDPQMLPRPSDLAVQTQRLERAVGQRATRSPAVTAPVRSHTPVRSWAP

SEQ ID NO: 4385 - protein, 321 aa, Nakamurella panacisegetis
MDDAELTEARRRRGRIQTALKEEFGPDCRVYLNGSVAHGDALTPLTDIDLGVVVPNPDGEFGPYANGPAKLQDRAANAIRDALKGEFPLLRVITGGRKRSVYVAFGAPVDPNESDFSADVIVAIDYPWGNGLWIPNYETWDRSDPEAHTRLVRDAIKLSNVNYTRTVRLLKHWVRRHSKLLCSWNIKALGLSCITGELNQLDGMVAWFDYAIADLSRRETPDPAGVAGPISIPGDRAEVVGRLTTARAKLVEAINYANDGYDVLAVDALAVFFNDPQMLPRPSDLAVQTQRLERAVGQRATRSPAVTAPVRSHTPVRSWAP

SEQ ID NO: 4386 - protein, 343 aa, Streptomyces scabiei
MVRKESLAQLLDEGRRKIQVTDKELAEAKRRRQLLATSVRRAFPGSTTYFNGSVAHGDANTPLTDVDLGVVLTKKDAQPYGPGKKSARPLMEIARDAIREDLKDEFPNLTVEVEGRRRTVLVRFGDPVTPGQADFTADVMTALPHPSGHGLYIPNTKIADQWDRADPITHTRMVLKAIDDTKVVFARTVRLLKHWNGTHSKPMCSWNIKALSLGCLDGPMPLINALQVFFTYAAIEIDKGPTPDPAKVAGPIPLNMPRSEVHKRLCTARKYIDLAIEHEKAGRPLSAQNALHQVLPELVPDVDATEEEADRLAGTVRSGGTALSGLGLATGLTTPTWPRAWGE

SEQ ID NO: 4387 - protein, 341 aa, Streptomyces scabiei
MVRKESLAQLLDEGRRKIQVTDEELDEAKRRRRLLAASARRVFPGSTTYFNGSVAHGDANTPLTDVDLGVVLTKKDAEPYGPGKKSALALMEIAREAIHEDLDAEFPKLTVEVAGRRRAVLVRFGDPVTQGQDDFTADVMTALPHPSDRGLYIPNTKIADQWDRADPITHTQMVLKAITDTKVVFARTVRLLKHWNCTHSKPMCSWNIKALCLGCLDEPMPLINALQVFFTYAADEIDKGPTPDPARVAGPIPLNMTRREVHKRLCTARDYVDLAIEHETAGRALSAQHALHQVLPELVPDADATQEEAARLTSTVRSGGTAATGLGLAVGLVTPTRAWGN

SEQ ID NO: 4388 - protein, 343 aa, Streptomyces sp.
MVRKENLAQLLEEGRRKIQVTDKELAEAKRRRQLLAASARRAFSGSTTYYNGSVAHGDANTPLTDVDLGVVLTKKDAEPYGPGKKSALDLMEKVREVIHEDLDDEFDKLTIEVEGRRRAVLVRFGDPVTPGQDDFTADVMTALPHPSGRGLYIPNTKIADQWDRADPITHTRMVLQAIEDTEVVFARTVRLLKHWNCTHSKPMCSWNIKALCLDCLDEPMPLINALQVFFTYAADEIDKGQTPDPAGVAGPIPLNMPRREVHKRLRTAKEYIDLAIEHEKADRPLSAQHALHQVLPELVTDADGTQEEAARLARTVLAGGTAASGLGLATGLGTSTRPRAWGD

SEQ ID NO: 4389 - protein, 343 aa, Streptomyces sp.
MVHKQTLAQLLDEGRRKIQVTDEELTEAKRRRRLLAASARRAFPGSTTYYNGSVAHGDANTPLTDVDLGVVLTKKEAEPYGPGKKSSLDLMEKVREVIHEDLDDEFDKLTIEVEGRRRAVLVRFGDPVTPGQDDFTADVMTALPHPSGRGLYIPNTKIADQWDCADPITHTRMVLQAIDDTEVVFARTVRLLKHWNCTHSKPMCSWNIKALCLGCLNEPIPLINALKAFFTFAADEIDKGQTPDPAGVAGPIPLNMPRADVHKRLCTARDYVDLAIEHERAGRSLSAQHVLHQVLPELVPDANGTQEEAGRLARTVFAGGTAASGLGLATRLITQTRPRAWGD

SEQ ID NO: 4390 - protein, 341 aa, Frankia alni
MGQTNDILNDVRGRIDAHAEPLAEARGRLRLSRDVAIGFRGALRTYPSGSLAQHTFIHPVADGDGGVVLDRRVYPALGPDGADESPEETIEALCSLLGPSIRNVYPKARCCTSRRGPKIYFVRPVDGQDPTIDLVMALTRRDGNGLWIPDLKKSKWEASDPEQHATLFTSGGKSRAQTRRRTIRLLKAWNRQYTTVGFSSHNLSVWAWEFITEGMGLPTALFSVLDKASTRLEAGYATKDPAGVSPNVKPLIDRSIAARRLRTAADAVSEALEHDDDREAVLSVLSRVYWKYLEDPTPSGLAGKAAMLRRPNPVSTAALGLSGRPALVRPTRAYGTPLHSA

SEQ ID NO: 4391 - protein, 341 aa, Frankia sp.
  MOD_RES (188)..(188): Any amino acid
  MOD_RES (225)..(225): Any amino acid
  MOD_RES (228)..(228): Any amino acid
MGQTNDILNDVRGRIDAHAEPLAEARGRLRLSRDVAIGFRGALRTYPSGSLAQHTFIHPVADGDGGVVLDRRVYPALGPDGADESPEETIEALCSLLGPSIRNVYPKARCCTSRRGPKIYFVRPVDGQDPTIDLVMALTRRDGNGLWIPDLKKSKWEASDPEQHATLFTSGGKSRAQTRRRTIRLLKXWNRQYTTVGFSSHNLSVWAWEFITEGMGLPTALFSVXDKXSTRLEAGYATKDPAGVSPNVKPLIDRSIAARRLRTAADAVSEALEHDDDREAVLSVLSRVYWKYLEDPTPSGLAGKAAMLRRPNPVSTAALGLSGRPALVRPTRAYGTPLHSA

SEQ ID NO: 4392 - protein, 341 aa, Unknown
  Description of Unknown: Frankia sequence
MGQTNDILNDVRGRIDAHAEPLAEARGRLRLSRDVAIGFRGALRTYPSGSLAQHTFIHPVADGDGGVVLDRRVYPALGPEGADESPEETIEALCSLLGPKIRNVYPKARCCTSRRGPKIYFGRPVDSQDPTIDLVMALTRRDGNGLWIPDLKKNKWEASDPERHATLFTSGGKSHAQTRRRTIRLLKAWNRQYTTVGFSSHNLSVWAWEFITEGMGLPTALFSVLDRASTRLEAGYATKDPAGVSPHVKPLIDRSIAARRLRTAADAVSEALQHDDDREAVLSALSRVYWKYLEDPTPSGLAGKAAMLRRPTPVSTAALGLSGRPALVRPTRAYGTPLRSA

SEQ ID NO: 4393 - protein, 289 aa, Armatimonadetes bacterium
MASTTAQAFAKFLEDISATDYQKETIITARKRTVDERLTEKFKSTSDMPYSHGLLMGSAEKNTIIRPIDDIDVLAVFSNVNDAWEKYKYDSKGFIYRIRDAYDGVSIQQVGTRGQAIRVFYQTGGHVDVAPVFSAGNDVYLLPNGSGGWINTSPTVASKWFAKRNQDLGYHLAPLVRLVKSWNRTHSKRMRSFHLETVAGTIFSSMGSNYRDAVLKFFEWSQGNLSVNDPGGQSGDLSSYLSRSGRNDLVQALASAADRAQKALKAEEDGDHAEAKRLWKIILGDSFPM

SEQ ID NO: 4394 - protein, 290 aa, Cellulomonas carbonis
MTLTTAQAFTQFLGDISATEYQETSIIQARKRTVDDRLSEKFPSAADMPYSEGVLMGSAAKGTIIRPFDDIDVLAVFSNVSNAWAKYQWDSKAFIYRIRDAYSGLSIQQVGTRGQAVRVFYKTGGHVDVAPVFAAGDGVYKLPNGSGGWIDTAPGIAGQWFARRNQELGYNLAPVVRLAKSWNRAHSKRMRSFHLETVAGSAFSKIGSNYREALEKFFEWAPRHLHVNDPGGHSGDLCTYLTWSAEQSLRQSLESAAERARRARAAEADGDHAEAKRLWKIVLGDDFPAA

SEQ ID NO: 4395 - protein, 289 aa, Brachybacterium sp.
MSLTTRQAFDKFLEDITATEYQRTSFIPARKKSVDEKLSAKFPSASDMPYARGILMGSASKNTIIRPLDDIDVLAVFSNVNKAWDKYWNDSHAFIYRVRDAYSGTLIQQVGTRGQAVRVFYKTGGHVDVAPVFSRGDGVYHLPDGTGGWILTAPTVAKDWFDERHRALGYHLAPLVRLAKAWNRVHSKRMRSFHLETASASMFKNLGGNHRSALQRFFEWTPNWLDVNDPGKQGGRLGGYLTWSARQELLTALSSAADRARRANEAEARGDHDEAKRLWRIILGSTFPN

SEQ ID NO: 4396 - protein, 281 aa, Microbacterium sp.
MAQFVADISITDYQKTSIVNARKDRVVENLTAAFPATSDLPFSRAILMGSAAKGTIVRPIDDIDVLAVFSNANGAWNTYRYDSQAFLYRVRRAYNGLSTAQVGARGQAVRIFFNNGGHVDVAPVFSHGNDVYGLPGGDGGWINTAPTVANAWFAQKHAELGYNLATLVRLLKKWNNAHSKRLRSFHLETIAARTFKTLGGNRQSALASFFEWAPSHLDVSDPGGQSGILSGYLTWTARQEVMQGLGSAAERARKANEAEARGDHDEAKRLWRIILGSGFPN

SEQ ID NO: 4397 - protein, 288 aa, Microbacterium sp.
MTTTSQAMAQFVTDISVTDYQKTSIINARKDRVVENLTAAFPATSDLPFSRAILMGSAAKSTIVRPMDDIDVLAIFSNANGAWNTYRFDSQAFLYRARRAYNGLSTAQVGARGQAVRIFFQNGGHVDVAPVFSHGNDVYGLPGGDGGWINTAPTVANAWFAQKHADLGYHLAPLVRLLKKWNNAHSKRLRSFHLETIAARTFKTLGGNRQSALASFFEWAPSHLDVSDPGGQSGILSGYLTSAARQEVLQGLGSAAERARKANDAEVRGDHDEAKRLWRIILGSSFPN

SEQ ID NO: 4398 - protein, 281 aa, Tessaracoccus massiliensis
MAQFLSDISVTDYQKTSIINSRKDRVVENLNAAFPDTSDLPFSRAILMGSAAKGTIVRPIDDIDVLAVFSNANGAWNTYRFDSQAFLYRVRRAYNGLSTAQVGARGQAVRIFFENGGHVDVAPVFSHGNDVYGLPGGDGGWINTAPTVANAWFAKKHADLGYNLAPLVLLLKKWNNAHSKRLRSFHLETITASTFKTLGSNRQSALASFFEWAPSHLDVGDPGGQSGTLSGYLTWAGRQEIIQALGSAAERARKANEAEARGDHDEAKRLWQIVLGSSFPK

SEQ ID NO: 4399 - protein, 288 aa, Micrococcus luteus
MTTTSQAMAQFLSDISVTDYQKTSIINSRKNRVVENLTAAFPDTSDLPFSRAILMGSAAKGTIVRPIDDIDVLAVFSNANGAWSTYRFDSQAFLYRVRRAYNGLSTAQVGARGQAVRIFFENGGHVDVAPVFSHGNDVYGLPGGDGGWINTAPTVANAWFAKKHADLGYNLAPLVRLLKKWNNAHSKRLRSFHLETITASTFKTLGSNRQSALTSFFEWAPSHLDVGDPGGQSGALSNYLTWAGRREVIQALSSAAERARKANEAEARGDHDEAKRLWQIILGSSFPK

SEQ ID NO: 4400 - protein, 281 aa, Rhodococcus rhodochrous
MAQFLSDISVTDYQKTSIINSRKNRVVENLTAAFPDTSDLPFSRAILMGSAAKGTIVRPIDDIDVLAVFSNANGAWSTYRFDSQAFLYRVRRAYNGLSTAQVGARGQAVRIFFENGGHVDVAPVFSHGNDVYGLPGGDGGWINTAPTVANAWFAKKHADLGYNLAPLVRLLKKWNNAHSKRLRSFHLETITASTFKTLGSNRQSALTSFFEWAPSHLDVGDPGGQSGALSNYLTWAGRREVIQALSSAAERARKANEAEARGDHDEAKRLWQIILGSSFPK

SEQ ID NO: 4401 - protein, 288 aa, Arthrobacter sp.
MTTTTQAIAQFLTDISVTDYQKTSIINARKDRVVENLATAFPATSDLPFSSAILMGSAAKGTITRPIDDIDVLAVFSNINDAWSSYRFDSKAFLYRVRRAYDGLSTAQVGARGQAVRIFFKNGGHVDVAPVFYHGNDVYGLPSGNGGWINTAPTIANNWFSGRHAELGYNLAPLVRLLKKWNNAHSKRLRSFHLETMTAHTFKTLGSNRQNALTSFFQWAPTFIDVSDPGGQSGTLSSYLSWAERQEVLQALKSAADRASKAQQAEASGDHAEAKRLWKIILGSSFSG

SEQ ID NO: 4402 - protein, 288 aa, Arthrobacter sp.; identical to SEQ ID NO: 4401

SEQ ID NO: 4403 - protein, 289 aa, Janibacter indicus
MTQTTSQAMAAFLEAITVTDYQKTSIIEARKNRVVKNLTGAFPPTSDLPFSHAVLMGSAAKGTIVRPIDDIDVLAVFSNANDAWSKYRWDSQSFLYRIRRAYDGTETAQVGARGQAVRVFFQTGGHVDVAPVFFHGDDVYGLPKGDGGWINTAPTVANSWFAKRNSDLGYNLAPLVRLLKKWNGSHSKRLRSFHLETMAASVFRTLGSSRRGGLTNFFEWAPNHLDASDPGGQSGSLSGYLSWTSRSEVIQSLRTAAERAAKAQAAEAVGDHAEAKRLWRIILGSSFPN

SEQ ID NO: 4404 - protein, 290 aa, Microbacterium hominis
MTLTTAQAFASFQESLTATAYQTGTLIPARRRGVEERLSGAFPSSSDLPFSECKMMGSAAKGTIIRPFDDVDVLAVFSNVKNAWNTYQWDSQSFIYRIRAAYSGLSVQQVGTRGQAVRVFYEGGGHVDIAPVFEVGSGVYKLPAGDGTWINTAPFIASNWYADRHRDLGYQLSPVVRLLKAWNRAHSRRLRSFHLETVAATVFGQLGTDHRVAVQRFFEWSQTRLAVADPGGQSGNLSSYLSWTAHQDVVQALESARVRASNAIAAEQRADHAEAKRQWAVIFGSDFPTS

SEQ ID NO: 4405 - protein, 290 aa, Microbacterium hominis; identical to SEQ ID NO: 4404

SEQ ID NO: 4406 - protein, 290 aa, Microbacterium ginsengisoli
MTLTTAQAFASFQESLTATAYQTGTLIPARRRGVEERLSGAFPSSSDLPFSECKMMGSAAKGTIIRPFDDVDVLAVFSNVKNAWNTYQWDSQSFIYRIRAAYSGLSVQQVGTRGQAVRVFYEGGGHVDIAPVFEVGSGVYKLPAGDGTWINTAPFIASNWYADRHRDLGYQLSPVVRLLKAWNRAHSRRLRSFHLETVAATVFGQLGTDHRVAVQRFFEWSQTRLAVADPGGQSGNLSGYLSWNAHQDVVQALESARVRAANAIAAEQRADHAEAKRQWAVVFGPDFPTS

SEQ ID NO: 4407 - protein, 290 aa, Microbacterium sp.
MTLTTAQAFASFQESLTATAYQTGTLIPARRRGVEERLSGAFPSSSDLPFSECKMMGSAAKGTIIRPFDDVDVLAVFSNVKNAWNTYQWDSQSFIYRIRAAYSGLSVQQVGTRGQAVRVFYEGGGHVDIAPVFEVGGGVYKLPAGDGTWISTAPFVASNWYADRHRDLGYQLSPVIRLLKAWNRAHSRRLRSFHLETVAATVFGQLGTDHRVAVLRFFEWSQTRLAVADPGGQSGNLSGYLSWTAHQDVVQALESARVRAANAIAAEQRADHAEAKRQWAVVFGPDFPTS

SEQ ID NO: 4408 - protein, 291 aa, Mycobacterium sp.
MALTTATAFDEFKEKLRLTDTQKETVKGRQSKTSEYLETAFPSSSDLVLNTTYLMGSAGRDTIIRPLDDVDVLAIFANKDDIFDRLYRYNSQKFLYRVRDALNEYQVEVVGARGQAVRLFYKAAPHVDIAPVFKWSGGGYALPNGFGGWLTTDPYAHHDWIAQRQKDLSYRLKPMVRMLKRWNNVHSKYFKGFHLEVVAATVFSSLGGDSRDACEKFFQWAQYNLTVMDPAGHGGDLSSYLTPAARTALLLNLESARARAAKANAAEASGDHKEAIRLWRIIFGDEFPTYG

SEQ ID NO: 4409 - protein, 292 aa, Unknown
  Description of Unknown: Mycobacterium chelonae group sequence
MALTTAQAFDEFYDAIKEDDATSQKVSDRRANVVNVLKAAFPSSATMQFQSAKLIGSLGRHTASRPFDDMDLLVHLHVDEDLWQGTYQYNSSDFLYRVRNSLSGSSTVKKVGARGQAVRFFYSDGLVVDIAAVVKITNGPYKIPDGSGGWLSTDPIEHAAYMNRRNSELDSNLKRFVVVAKQWNEAHSSHLSSFHLEMMAARTFATLGTNRRTALRLFFDYNQYNLSVQDPAGYGGDLSTYLTPNARTLVNTGLGAARDRADLAIAAEDRGDARESIRQWGIILGSRFPAYG

SEQ ID NO: 4410 - protein, 292 aa, Mycobacterium abscessus
MALTTAQAFDEFYDAIKEDDATSQKVSDRRANVVNVLKAAFPSSATMQFQSAKLIGSLGRHTASRPFDDMDLLVHLHVDEDLWQGTYQYNSSDFLYRVLNSLSGSSTVKKVGARGQAVRFFYSDGLVVDIAAVVKITNGPYKIPDGSGGWLSTDPIEHAAYMNRRNSELDSNLKRFVVVAKQWNEAHSSHLSSFHLEMMAARTFATLGTNRRTALRLFFDYNQYNLSVQDPAGYGGDLSTYLTPNARTLVNTGLGAARDRADLAIAAEDRGDARESIRQWGIILGSRFPAYG

SEQ ID NO: 4411 - protein, 292 aa, Streptomyces scabiei
MATTIVAAFNEFDTKVKPSPATWTKVYERRDIVVNVIKAAFPAGNDIRYQSHKIIGSLGRNTACNPVDDIDLMVHLHVDQDLWNRKYRDNSSEFLYRVRKVLNENSPVRKIGARGQAVRFFYADGLSVDVAPVEKYTSGDYGIPDGAGNWLTTNPNKHETHLNERSNALDGDLKKIIRFAKKWNKAHSSRLSSFHLEMLVARTYGTLGSNSRKALRLFFDYNLYNLSVQDPAGFSGDLSTYLNWASKDAVNDSLKSARDRADLALAAEDRGDYREAIRLWRIILGSDFPTYG

SEQ ID NO: 4412 - protein, 355 aa, Frankia alni
MDTPRGTPAGVRPGEVTYDHLIIPSHWRRSNESTPGAPNALFPPDGGASPQQVPPPINPTTGAMTGPLLVGTTARAFAKLDDLIRLSAEDKAVIAARRDEAERALRAIFPPRCALPLVGVATIGSAGRDTMIQPLDEVDIFAVFSAANSAWKRFRWDSRDLVLCVRNAIGGERIQTIGSRGQALRIVYDSPPDVHLVPAFDHPRAGYVMPDRVGGWLPTRPERHTSWTADLGPRVISAVRLLKAWNRVCGSHLRSFHIEALAGQVLAGRGLNTRQGLAEVFRHMDEVGLVAADPADVGGDLSAYLRPEDVDALAGTIRLARIYSAKAVDAEQAGDHEEAVALWGSVFGPEFPTFG

SEQ ID NO: 4413 - protein, 357 aa, Frankia alni
MSVDTPRGTPAGVRPGEVTYDHLIIPSHWRRSNESTPGAPNALFPPDGGASPQQVPPPINPTTGAMTGPLLVGTTARAFAKLDDLIRLSAEDKAVIAARRDEAERALRAIFPPRCALPLVGVATIGSAGRDTMIQPLDEVDIFAVFSAANSAWKRFRWDSRDLVLCVRNAIGGERIQTIGSRGQALRIVYDSPPDVHLVPAFDHPRAGYVMPDRVGGWLPTRPERHTSWTADLGPRVISAVRLLKAWNRVCGSHLRSFHIEALAGQVLAGRGLNTRQGLAEVFRHMDEVGLVAADPADVGGDLSAYLRPEDVDALAGTIRLARIYSAKAVDAEQAGDHEEAVALWGSVFGPEFPTFG

SEQ ID NO: 4414 - protein, 357 aa, Frankia sp.
  MOD_RES (28)..(28): Any amino acid
MSVDTPRGTPAGVRPGEVTYDHLIIPSXWRRSNESTPGAPNALFPPDGGASPQQVPPPINPTTGAMTGPLLVGTTARAFAKLDDLIRLSAEDKAVIAARRDEAERALRAIFPPRCALPLVGVATIGSAGRDTMIQPLDEVDIFAVFSAANSAWKRFRWDSRDLVLCVRNAIGGERIQTIGSRGQALRIVYDSPPDVHLVPAFDHPRAGYVMPDRVGGWLPTRPERHTSWTADLGPRVISAVRLLKAWNRVCGSHLRSFHIEALAGQVLAGRGLNTRQGLAEVFRHMDEVGLVAADPADVGGDLSAYLRPEDVDALAGTIRLARIYSAKAVDAEQAGDHEEAVALWGSVFGPEFPTFG

SEQ ID NO: 4415 - protein, 357 aa, Unknown
  Description of Unknown: Frankia sequence
MSVDTPRGTPAGVRPGEVTYDHLIIPSHWRRSNESTPGAPNALFPPDGGASGQQVPPPINPTTGAMTGPLLVGTTARAFAKLDDLIRLSAEDKAVIAARRDEAERALRAIFPPRCALPLVGVATIGSAGRDTMIQPLDEVDIFAVFSAANSAWKRFRWDSRDLVLCVRNAIGGERIQTIGSRGQALRIVYDSPPDVHLVPAFDHPRAGYVMPDRVGGWLPTRPERHTSWTADLGPRVISAVRLLKAWNRVCGSHLRSFHIEALAGQVLVGRGLNTRQGLAEVFRHMDEVGLVAADPADVGGDLSAYLRPEDVDALAETIRLARIYSAKAVDAEQAGDHEEAVALWGSVFGPEFPTFG

SEQ ID NO: 4416 - protein, 357 aa, Frankia sp.
  MOD_RES (100)..(100): Any amino acid
  MOD_RES (201)..(201): Any amino acid
  MOD_RES (351)..(351): Any amino acid
MSVDTPRGTPAGVRPGEVTYDHLIIPSHWRRSNESTPGAPNALFPPDGGASGQQVPPPINPTTGAMTGPLLVGTTARAFAKLDDLIRLSAEDKAVIAARXDEAERALRAIFPPRCALPLVGVATIGSAGRDTMIQPLDEVDIFAVFSAANSAWKRFRWDSRDLVLCVRNAIGGERIQTIGSRGQALRIVYDSPPDVHLVPXFDHPRAGYVMPDRVGGWLPTRPERHTSWTADLGPRVISAVRLLKAWNRVCGSHLRSFHIEALAGQVLVGRGLNTRQGLAEVFRHMDEVGLVAADPADVGGDLSAYLRPEDVDALAETIRLARIYSAKAVDAEQAGDHEEAVALWGSVFGXEFPTFG

SEQ ID NO: 4417 - protein, 357 aa, Frankia sp.
MSVDTPRGTPAGVRPGEVTYDHLIIPSHWRRSNESTPGAPNALFPPNGGAPAQPAPPPINPTTGAMTGPLLVGTTARAFAKLDDLIRLSAEDKAVIAARRDEAERALRAIFPPRCALPLVGVATIGSAGRDTMIRPLDEVDIFAVFSAANSAWKRFRWDSRDLVLCVRNAIGGERIQTIGSRGQALRIVYDSPPDVHLVPAFDHPRAGYVMPDRVGGWLPTRPERHTSWTADLGPRVISAVRLLKAWNRVCGSHLRSFHIEALAGQVLAGRGLNTRQGLAEVFRHMDEVGLVAADPADVGGDLSAYLRPEDVDALGETIRLARIYSAKAVDAEQAGDHEEAVALWGSVFGPEFPTFG

SEQ ID NO: 4418 - protein, 365 aa, Unknown
  Description of Unknown: Frankia sequence
MSVDTPRGTPAGVRPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRDTMIRPLDEVDIFAVFSAANSAWKRFRWDSRDLLLCVRNAIGGDRIQTIGSRGQALRIVYDAPPDVHLVPAFDHPRAGYVIPDRVGGWLPTRPERHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEAVNLWGSLFGPEFPTFG

SEQ ID NO: 4419 - protein, 365 aa, Frankia sp.
  MOD_RES (201)..(201): Any amino acid
  MOD_RES (349)..(349): Any amino acid
MSVDTPRGTPAGVRPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRDTMIRPLDEVDIFAVFSAANSAWKRFRWDSRDLLLCVRNAIGGDRIQTIGSRGQALRIVYDAXPDVHLVPAFDHPRAGYVIPDRVGGWLPTRPERHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEXVNLWGSLFGPEFPTFG

SEQ ID NO: 4420 - protein, 365 aa, Frankia sp.
  MOD_RES (180)..(180): Any amino acid
MSVDTPRGTPAGVRPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRDTMIRPLDEVDIFAVFSAANSAWKRFRWDSRDLLLCVRNAIXGDRIQTIGSRGQALRIVYDAPPDVHLVPAFDHPRAGYVIPDRVGGWLPTRPERHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEAVNLWGSLFGPEFPTFG

SEQ ID NO: 4421 - protein, 365 aa, Frankia sp.
  MOD_RES (180)..(180): Any amino acid
  MOD_RES (233)..(233): Any amino acid
MSVDTPRGTPAGVRPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRDTMIRPLDEVDIFAVFSAANSAWKRFRWDSRDLLLCVRNAIXGDRIQTIGSRGQALRIVYDAPPDVHLVPAFDHPRAGYVIPDRVGGWLPTRPEXHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEAVNLWGSLFGPEFPTFG

SEQ ID NO: 4422 - protein, 365 aa, Frankia sp.
  MOD_RES (14)..(14): Any amino acid
  MOD_RES (156)..(156): Any amino acid
MSVDTPRGTPAGVXPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRDTMIRPLDEVDIFAVFSXANSAWKRFRWDSRDLLLCVRNAIGGDRIQTIGSRGQALRIVYDAPPDVHLVPAFDHPRAGYVIPDRVGGWLPTRPERHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEAVNLWGSLFGPEFPTFG

SEQ ID NO: 4423 - protein, 365 aa, Unknown
  Description of Unknown: Frankia sequence
  MOD_RES (139)..(139): Any amino acid
MSVDTPRGTPAGVRPSEVTYDHLIIPPDWRRPKESAPGTLNALFPSEGGPRAEPAAAGSTSPINPTTGPLTGPLTGPLLVGTTARAFAKLDDLIRLGAEDRAVVAARRDEAERALRAIFPPRCALPLVGVATIGSAGRXTMIRPLDEVDIFAVFSAANSAWKRFRWDSRDLLLCVRNAIGGDRIQTIGSRGQALRIVYDAPPDVHLVPAFDHPRAGYVIPDRVGGWLPTRPERHTSWTADLGPRVISAVRLLKAWNRVRGSHLRSFHIEALAGQVLAGRGLNTRQGLAEVFRHLDDVGLTVADPADVGGDLSSYLRAEDIEALAESVRLARIYSAKAVDAEQAGDHEEAVNLWGSLFGPEFPTFG

SEQ ID NO: 4424 - protein, 363 aa, Frankia sp.
MSVDARREVPAGTRPSEVTYDHLIIPPHWRRPAGSTPGSPNTLFPRGEQTTAPPPGPAVTGASPINPVTGPMTGPLLVGTTARAFAKLDDLVRLSENDRAVIDERRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRYMDEIGLAVGDPSDIRGDLSSYLRRDDLDDLAVCVRQARDFSARAVAAERAGRHEEAVSLWGTVFGPEFPTFG

SEQ ID NO: 4425 - protein, 363 aa, Unknown
  Description of Unknown: Frankia sequence
MSVDARREVPAGTRPSEVTYDHLIIPPHWRRPAGSAPGAPNTLFPRGEQTTAPPPGPAVTGASPINPVTGPMTGPLLVGTTARAFAKLDDLVRLSENDRAVIDERRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRYMDEIGLAVGDPSDIRGDLSSYLRRDDLDDLAVFVRQARDFSARAVAAERAGRHEEAVSLWGTIFGPEFPTFG

SEQ ID NO: 4426 - protein, 363 aa, Frankia sp.
MSVDARREVPAGTRPSEVTYDHLIIPPHWRRPAGSAPGAPNTLFPRGEQTTAPPPGPAVTGASPINPVTGPMTGPLLVGTTARAFAKLDDLVRLSENDRAVIDERRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRYMDEIGLAVGDPSDIRGDLSSYLRRDDLDDLAVYVRQARDFSARAVAAERAGRHEEAVSLWGTIFGPEFPTFG

SEQ ID NO: 4427 - protein, 363 aa, Frankia sp.
MSVDARREVPAGTRPSEVTYDHLIIPPHWRRPAGSGPGEPNTLFPRGEQATAPPPGPAVTGASPINPVTGPMTGPLLVGTTARAFAKLDDMVRLSEADRAVIDDRRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTLDLGPRVISAVRLLKAWNRVCGSHLRSFHIEALAGQVLAGRGFNTRQGLAEVFRYMDEVGLVVGDPSDIGGDLSSYLRQDDLHDLAACVRQARTYSARAVAAERAGNHEEAVSLWGSVFGPEFPTFG

SEQ ID NO: 4428 - protein, 363 aa, Frankia elaeagni
MSVDARQGVPTGTLSSEVTYDHLIIPPHWRRPAGSAPGKPNTLFPVDEQAAAPPPGPAVTGASPINPVTGPVTGPLLVGTTARAFAKLDDLVRLSEEDRAVIDGRRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRIGGWLPTRPERHASWTMDLGPRVISAVRLLKAWNRVCGSHLRSFHIEALAGQVLAGRGLNTRQGVAEVFRYMDEVGLAVGDPSDIRGDLSSYLRPDDLQDLGAGVRQARIYAQRAVAAERAGNHEEAVSLWGAVFGPEFPTFG

SEQ ID NO: 4429 - protein, 363 aa, Frankia sp.
MSVDARQGVPAGTLSSEVTYDHLIIPPHWRRPAGSAPGKPNTLFPVDEQAAAPPPGPAVTGASPINPVTGPVTGPLLVGTTARAFAKLDDLVRLSEDDRAVIDGRRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRIGGWLPTRPERHASWTMDLGPRVISAVRLLKAWNRVCGSHLRSFHIEALAGQVLAGRGLNTRQGVAEVFRYMDEVGLAVGDPSDIRGDLSSYLRPDDLQDLGAGVRQARIYAERAVAAERAGNHEEAVSLWGAVFGPEFPTFG

SEQ ID NO: 4430 - protein, 363 aa, Frankia sp.
MSVDARREVPTGTRSSEVTYDHLIIPPHWRRPAGPGPGEPNPLFPAGEQATAPPPGPAVTGASPINPMTGPMTGPLLVGTTARAFAKLDDMVRLGDDDRAVIDDRRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRHMDEVGLVVGDPSDIRGDLSSYLRQDDLEDLGAFVRQARTYSAKAVAAERAGDHEEAVSLWGTVFGPEFPTFG

SEQ ID NO: 4431 - protein, 363 aa, Frankia sp.
  MOD_RES (174)..(174): Any amino acid
MSVDARREVPTGTRSSEVTYDHLIIPPHWRRPAGPGPGEPNPLFPAGEQATAPPPGPAVTGASPINPMTGPMTGPLLVGTTARAFAKLDDMVRLGDDDRAVIDDRRAEAERALRSIFPPRCALPLVGVATIGSAGRDTMIRPLDEVDIFVVFSAANSAWKRFRWDSRDLLVCVXNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRHMDEVGLVVGDPSDIRGDLSSYLRQDDLEDLGAFVRQARTYSAKAAAAERAGDHEEAVSLWGTVFGPEFPTFG

SEQ ID NO: 4432 - protein, 363 aa, Frankia discariae
MSVDARREVPTGTRSSEVTYDHLIIPPHWRRPAGSAPGEPNTLFPASEQAMAPPPGPAVTGASPINPMTGPMTGPLLVGTTARAFAKLDDLVRLGDDDRAVIDDRRAEAERALRSIFPPRCALPLVGVATIGSAGRDTMIRPLDEVDIFVVFSAANSAWKRFRWDSRDLLVCVRNAIGGDRVQTIGTRGQALRIVYDAAPDVHLVPAFDHPRAGYVIPDRVGGWLPTRPERHASWTMDLGPRVISAVRLLKAWNRVCGSHLRSFHIEALAGQVLAGRGLNTRQGLAEVFRYMDEVGLAVGDPSDIRGDLSSYLRRDDLEDLGAVVRQARVYSAKAVAAERAGDHEEAVSLWGTVFGPEFPTFG

SEQ ID NO: 4433 - protein, 361 aa, Unknown
  Description of Unknown: Frankia sequence
MSVDSPHPISSQIPPAEVTYDHLIIPPHWRRPDESVPGAPNSLFPTVDAPPAQAQPASGPHLTGPHTGAMTGPLLVGTTARAFAKLDDMIRLSSEDKAVIDARRDEAERALRAIFPPRCALPLVGVATIGSAGRDTMIRPLDEVDIFAVFSAAGGAWKRFRWDSRDLLLCVRGAIGGDRVQTIGTRGQALRVVYDTPPDVHLVPAFDHPRAGYVMPDRVGGWLPTRPERHASWTEDLGPRVISAVRLLKAWNRVCGSHLRSFHIEALAGTVLAGRGLNTRQALTTVFRHMEEVGLSMADPADVGGDLSTYLRPDDLGALEESIRLARSYSEKAILAEADGRHEEAVAFWAAIFGPEFPTFG

SEQ ID NO: 4434 - protein, 360 aa, Frankia asymbiotica
  MOD_RES (51)..(51): Any amino acid
MNVDSPHPVSSQTPPAEVTYDHLIIPPHWRRPDESMPGAPNSLFPVDAPPXPAQPTSGPHPTGPHTGAMTGPLLVGTTARAFAKLDDMIRLSSEDKAVIDARRDEAERALRAIFPPRCALPLVGVATIGSAGRDTMIRPLDEVDIFAVFSAAAGAWKRFRWDSRDLLLCVRGAIGGDRVQTIGTRGQALRVVYDSPPDVHLVPAFDHPRAGYVMPDRVGGWLPTRPERHASWTEDLGPRVISAVRLLKAWNRVCGSHLRSFHIEALAGTVLAGRGLNTRQALTTVFRHMEDVGLSVADPADVGGDISTYLRPDDLVALGQSIRLARSYAEKAVLAEADGRHEEAVAFWATIFGPEFPTFG

SEQ ID NO: 4435 - protein, 355 aa, Frankia sp.
MSVDSPHPVSSQTPPAEVTYDHLIIPPHWRRPDESIPGAPNSLFPVDAPAAPAQTTSGPHTGAMTGPLLVGTTARAFAKLDDMIRLSSEDKAVIDARRDEAERALRAIFPPRCALPLVGVATIGSAGRDTMIRPLDEVDIFAVFSAAAGAWKRFRWDSRDLLLCVRGAIGGDRVQTIGTRGQALRVVYDSPPDVHLVPAFDHPRAGYVMPDRVGGWLPTRPERHASWTEDLGPRVISAVRLLKAWNRVCGSHLRSFHIEALAGTVLAGRGLNTRQALTTVFRYMEEVGLSVADPADVGGDLSTYLRPDDLAALGESIRLARSYAEKAVVAEADGRHEEAVAFWAAIFGPEFPTFG

SEQ ID NO: 4436 - protein, 351 aa, Frankia inefficax
MSVDTPRPVSAATPPAEVTYDHLIIPPHWRRPEDSVAGAPNPLFPSADGQPHPASGPHPMTGPLLVGTTARAFAKLDDIIRLSTEDKAVIDARRDEAERALRAIFPPRCALPLVGVATIGSAGRDTMIRPLDEVDIFAVFSAANSAWKRFRWDSRDLLLCVRNAIGGDRVQTIGTRGQALRVVYDTPPDVHLVPAFDHPRAGYVMPDRIGGWLPTRPERHASWTEDLGPRVISAVRLLKAWNRVCGSHLRSFHIEALAGTVLAGRGLNTRQALATVFRHMDEAGLSMADPADVGGDLSTYLRPDDLAALGESVRMARAYAEKAVAAEGDGRHEEAVALWAAIFGPEFPTFG

SEQ ID NO: 4437 - protein, 351 aa, Frankia sp.
MSVDTPRPVSAATPPAEVTYDHLIIPPHWRRPEDSVAGAPNPLFPSVDGPAHPASGPYPMTGPLLVGTTARAFVKLDDIIRLSAEDKAVIDARRDEAERALRAIFPPRCALPLVGVATIGSAGRDTMIRPLDEVDIFAVFSAANSAWKRFRWDSRDLLLCVRNAIGGDRVQTIGTRGQALRVVYDTPPDVHLVPAFDHPRAGYVMPDRIGGWLPTRPERHASWTEDLGPRVISAVRLLKAWNRVCGSRLRSFHIEALAGTVLAGRGLNPRQALATVFRHMDEVGLSMTDPADVGGDLSTYLRPDDLGALGESVRMARAYSEKAVAAEGDGRHEEAVALWATIFGPEFPTFG

SEQ ID NO: 4438 - protein, 372 aa, Unknown
  Description of Unknown: Frankia symbiont of Datisca glomerata sequence
MSVETQREAAFAGTLDGSLPGQRASEVTYDHLIIPPHWRRSEESGPGAHNPLFAGDPAVSPLNPPTGPITGPITGPITGGMTSPLLVGTTARAFAKLDDLIRLNADDRAVIDARRNDAEQALRTIFPPRCALPLVGVATIGSAGRDTMIRPVDEVDIIVVFSAANSAWKRFRWDSRDLLLRVRNAIGGDRIQMIGSRGQAMRVVYNCAPDVHLVPAFDHPRAGYVMPDCVGGWLPTRPERHASWMADAGPRVASAVRLLKAWNRVYGSRLRSFHLEALAGKILINRGLNTRQGLAAVFRHIESRGFAAYDPAEVGGDLSTYLQPQDVDALREPVAFARARADEAVEAEQVGRHEEAVNLWRLIFGPEFPTFG

SEQ ID NO: 4439 - protein, 372 aa, Unknown
  Description of Unknown: Frankia sequence
MSVETQREAAFAGTLDGSLPGQRASEVTYDHLIIPPHWRRSEESGPGAHNPLFAGDPAVSPLNPPTGPITGPITGPITGGMTSPLLVGTTARAFAKLDDLIRLNADDRAVIDARRNDAEQALRTIFPPRCALPLVGVATIGSAGRDTMIRPVDEVDIIVVFSAANSAWKRFRWDSRDLLLRVRNAIGGDRIQMIGSRGQAMRVVYNCAPDVHLVPAFDHPRAGYVMPDCVGGWLPTRPERHASWMADAGPRVASAVRLLKAWNRVYGSRLRSFHLEALAGKVLINRGLNTRQGLAAVFRHIESRGFAAYDPAEVGGDLSTYLQPQDVDALREPVAFARARADEAVEAEQVGRHEEAVNLWRLIFGPEFPTFG

SEQ ID NO: 4440 - protein, 292 aa, Streptomyces sp.
MDTQVGTAFSHFYGSITPPDSYLQLAMRRVRKLATDITRASSMDGPWYAFLGYRLMGSYARRTAIRQSSDVDVMFEFAAGDSPHAHDSLSLLTYLEECLSELLGGAADLSRMREVVSVSFPGEVTIDILPCIKSSRGGYLFPGGFGRWAVTDPDTQNAYFKERCDASRIDLSKFTRGIKQWNVENGGILRSYHLEAMVANVADKLGDNYSIATLRFYETYAEGLSVQDPAGQQGDLSSYLTPCQRKAVSVLIENYRNKAHLAVSAQDDRRYTQAVEAWARVYGPCFPSPDEQ

SEQ ID NO: 4441 - protein, 253 aa, Mycobacterium sp.
MLDRLRNNGIEVLEAIAFGSIPRYTALKEHADVDVMAVLHYGKHIKDRRPSQVLLAVKNALGTGQAGAGRRNGQAVTVSFQSWPNIDVVPALRVNDNNGKVTGYEIPDMKREIWLPTNPPQHSSDIAAAVTARGSRFRRVITMLKHWNRRQPVKLQSYHLEVIALKLSTSWDDYSWPIFKWFELAQSEIHWCWHAGQDVSGYLNYEQRQAITAQLASATNTARSAWLKACTDKHSEAISLWRNVFGMKFPTYG

SEQ ID NO: 4442 - protein, 285 aa, Unknown
  Description of Unknown: Mycobacterium sequence
MAWTTEAAFARFYEEVNLPGDHRTTANARRDWVLDRLRNNGIEVLEAIAFGSIPRYTALKEHADVDVMAVLHYGKHIKDRRPSQVLLAVKNALGTGQAGAGRRNGQAVTVSFQSWPNIDVVPALRVNDNNGKVTGYEIPDMKREIWLPTNPPQHSSDIAAAVTARGSRFRRVITMLKHWNRRQPVKLQSYHLEVIALKLSTSWDDYSWPIFKWFELAQSEIHWCWHAGQDVSGYLNYEQRQAITAQLASATNTARSAWLKACTDKHSEAISLWRNVFGMKFPTYG

SEQ ID NO: 4443 - protein, 285 aa, Mycobacterium liflandii
MAWTTEAAFARFYEEVNLPGDHRTTANARRDSVLDRLRNNGIEVLEAIAFGSIPRYTALKEHADVDVMAVLHYGKHIKDRRPSQVLLAVKNALGTGQAGAGRRNGQAVTVSFQSWPNIDVVPALRVNDNNGKVTGYEIPDMKREIWLPTNPPQHSSDIAAAVTARGSRFRRVITMLKHWNRRQPVKLQSYHLEVIALKLSTSWDDYSWPIFKWFELAQSEIHWCWHAGQDVSGYLNYEQRQAITAQLASATNTARSAWLKACTDKHSEAISLWRNVSGMKFPTYG

SEQ ID NO: 4444 - protein, 285 aa, Mycobacterium ulcerans
MAWTTEAAFARFYEEVNLPGDHRTTANARRDWVLDRLRNNGIEVLEAIAFGSIPRYTALKEHADVDVMAVLHYGKHIKDRRPSQVLLAVKNALGTGQAGAGRRNGQAVTVSFQSWPNIDVVPALRVNDNNGKVTGYEIPDMKREIWLPTNPPQHGSDIAAAVTARGSRFRRVITMLKHWNRRQPVKLQSYHLEVIALKLSTSWDDYSWPIFKWFELAQSEIHRCWHAGQDVSGYLNYEQRQAITAQLASATNTARSAWLKACTDKHSEAISLWRNVFGMKFPTYG

SEQ ID NO: 4445 - protein, 285 aa, Mycobacterium sp.
MVWTTEAAFARFYEEVNLPGDHRTTANARRDWVVDRLRNTGIEVLEAIAFGSIPRYTALKEHADVDVMAVLHYGKHIKDRRPSQVLLAVKNALGTGQAGAGRRNGQAVTVSFQSWPSIDVVPASRVNDNNGKVTGYEIPDMTREIWLPTNPPQHSSDIAAAVTARGSRFRRVITMLKHWNRRQPVKLQSYHLEVIALKLSTSWDDCSWPVFKWFEFAQSEIHWCWHAGQDVSGYLNYEQRQAITAQLASATNTARGAWLKTCTDKHSEAIPLWRNVFGMKFPTYG

SEQ ID NO: 4446 - protein, 285 aa, Mycobacterium arupense
MAWTTEAAFERFYDEVNLPGDHHATANARRDWVLGRLRNNGIDVLDAIAFGSIPRYTALKEHADVDVMAVLHYGKHIKDRQPSEVLLAVKNALGTGQAGTGRRNGQAVTVTFESWPNIDVVPASRLTDNNGQVTGYNIPDMTREIWLPTNPPQYSSEIATAVSARGPRFRRVITMLKHWNRRQTVKLQSYHLEVITLKLETSWSDYSWPVYQWFEIAQSEIDWCWHAGQDISGYLGVEQRRAIAAQLKAAENTANNAWYKAYKGLHSEAIPLWRNIFGIKFPTYG

SEQ ID NO: 4447 - protein, 285 aa, Streptomyces leeuwenhoekii
MAWTVDSAFSEFHQNINLPGDHRTTANTRKDWVLRQLGTSFTVLDAFTMGSIPRFTALKGYADLDIMAVLHYEKHIKGRLPSTVLSNVKRALGPGAGNVRRNGQAVTIKFQSWPNIDVVPAVRHVNDAGQVTHYEIPDMNREVWLETKPRNHASKVSQKSADHGPKFRQVIKFIKDWNRRQSVRLQSYHIEVIALQTSTDWKEYDWSVLQWFSQAKSSIYSCWNDGNDVSQYLTPDRAYKIQQAVNGAHSAALNAWYATAGPAKDQAAAIRGWKSVFGQNFPNYG

SEQ ID NO: 4448 - protein, 286 aa, Candidatus Kaiserbacteria bacterium
MPYTLPVSFDKFRENIELGSTYRETAQKRRNRLVSLLENDFKILEAFPTGSVPRFTAVKGHADLDVIVVLHFGKHIKNKKPSQVLQDVRDVLGDYKTGVRKNGQAVTLHYDSWPDVDIVPVSVTYNDDGSVNHYNVPDMNTESWIDSRPKKHSSTLTERNKTCGENFKRLIKMMKWWNHQHSGLMHSFHIEVLALKTFHGKMDDLPWDIYYLFKNSVDLAQNSLWYELDYVDDYLDYSKRQEVIKRLETARDWASDAWSYARKDNVEKAIEKYRQIFGSKFPAYGS

SEQ ID NO: 4449 - protein, 287 aa, Bordetella petrii
MPYTVEGSFNAFYENINLGGDHRETANKRRDDIVNTLSKTFSIVEAFSSGSIPKYTALKNHADLDVIVALHHGKHINGKTPTQVLQSVRDALAEWRTGVRKNGQAVTLYYKTWPNVDIVPVSRVVNDDGGFLYYKVPDSNTDTWIYSRPKTHTADIEKKSSDCGYNFRRIIKMIKHWNRIHSDYLRSYHIEVLALKTFDSNLNDTPWSVFQFFEKARPLLAGSLWHEFGFADSYLSRSDREEVLKRFDTAIYKSRSAWYKTYDKNDDHKGAIEIWKQMFGDKFPAYG

SEQ ID NO: 4450 - protein, 287 aa, Aquincola tertiaricarbonis
MAYTVEGSFDAFYENINLGGDHREIANKRRDDIINTLGKTFSIVEAFGSGSIPKYTALKNHADLDVIVALHHGKHIDGKTPTQVLQSVRDALAEWRTGARKNGQAVTLYYKTWPNVDIVPVSRVVNDDGSVSYYNVPDSNTDTWIASRPKTHAADIEKRSSDCGYNFRRIIKMIKHWNRIHSEYLQSYHIEVLALKVFDSNLDDTPWSVFQFFDKARPLLAGNLWHELGFVDSYLSWSDREEVLNRFDTAIDRSRSAWHKTYDKNDDHKGAIEIWKQMFGDMFPAYG

SEQ ID NO: 4451 - protein, 287 aa, Bradyrhizobium sp.
MAYTVDAAFNTFYEQINLSGDYRETANKRRERIVELLKNDFEILDSFGTGSIPKFTALKGHADLDVMVVLHFGKHIKDKKPSTVLQNVRNSLAEYRTGVRSNGQAVTLYYDTWPNVDIVPVSRVVDNNQNVTHYEVPNSNTEGWMPSRPKKHANAIESRSTDCGQNFRRIIKMIKHWNRIHSGYLTSYHIEVLALDIFHTNLDDLPWNIHLFFDNAINLVKSSLWYEVNYADAYLTDAARAEAVKRLEAAKAKSLTAWYATHGANSDHQAAITAWKQIFGDKYPAYG

SEQ ID NO: 4452 - protein, 288 aa, Pandoraea sp.
MAYTVDAAFTQYYDNINLSGDFRALASARRDHIFNLLGNRFHVVDAFAGGSIPKYTALMNHADLDIFVVLHYQKHCEGKRPSQVLQDMRIALAAKPGVRRNGQAVTLTYASFPDVDVVPVFFTSHDGMRYADSLFLNVPDMNTETWIRSMPQAHAGKIEAAATDLGANFRRVIKFVKHWNWKHGDLLRSFHIETLALATLDSTKLTDLPWAMCMFFKDISDSILMPFYYEGDRIDEYITISDRLNLNAKLKLAKDQSNAAWVSGYLGMNEDAINKWYRIFGNEFPTYG

SEQ ID NO: 4453 - protein, 288 aa, Burkholderia sp.
MAYTVDAAFTQYYDNINLSGDFRALASARRDHIFNLLANRFHVVDAFAGGSIPKYTALRNHADLDIFVVLHYRKHCEGNRPSQVLQDMRTALAAKPGVRRNGQAVTLTYASFPDVDVVPVFFTSHDGMRYADSLFLNVPDMNTETWIRSMPQAHAGKIEAAAAELGANFRRVIKFVKHWNWKHGDLLRSFHIETLALATLDSTKLTDLPWAMCMFFKDISDRILMPSYYEGDRIDEYLTASDRANLNTRLKLLKDQSNAAWASGYLGMSEDAINKWHIIFGNEFPTYG

SEQ ID NO: 4454 - protein, 321 aa, Burkholderia sp.
MALFRRHGRYDFAIGFVNGYIRNPIKTKASRANVAYTVDAAFTQYYDNINLSGDFRALASARRDHIFNLLANRFHVVDAFAGGSIPKYTALRNHADLDIFVVLHYRKHCEGNRPSQVLQDMRTALAAKPGVRRNGQAVTLTYASFPDVDVVPVFFTSHDGMRYADSLFLNVPDMNTETWIRSMPQAHAGKIEAAAAELGANFRRVIKFVKHWNWKHGDLLRSFHIETLALATLDSTKLTDLPWAMCMFFKDISDRILMPSYYEGDRIDEYLTASDRANLNTRLKLLKDQSNAAWASGYLGMSEDAINKWHIIFGNEFPTYG

SEQ ID NO: 4455 - protein, 305 aa, Burkholderia sp.
MTILRAYNLPTTNRGLYVAYTVDGAFAEFYDEINLSGDFRALASARRDHIFNLLGNRFHLIDAFAGGSIPKYTALHGRADMDIFVVLHYGKHCAGRLPSQVLLDIRTALSGKERVRRNGQAVTLRYTAFPDVDVVPVYFTSHDGQRYEDAQYLNVPDMNTETWIRSMPKLHTARVEQAAAAYGKYFRRAIKMMKYWNWKHGDILRSFHIEALAVLFLGIGDCSSLPLALHRFFDAVHGSVLTAVHYDGARIDDYLTAQDRIGLSDRLRSACTHANSAWLNGFLGNHEFAIAEWRAIFGDPYPSYG

SEQ ID NO: 4456 - protein, 283 aa, Shewanella pealeana
MPYTIAVSFDKFIERISITGNQADIAESRCKSIVNLLGKEFNILEAFPLGSLVSGTSLSGFADADVMLVLHYGAHAENKSPTEFLQSVRDKLSEYNTRMAKKNGQAVTLYFKTWPNVDIVPAYRVSDDGSFYCYKIPNANNNSWIETRPKIHINNMKKASAQKIHLIKMIKEWNRKHSSYLSSFHIEVMALSYENFYSDYAWHVFKFFEHMHTKIQSYIPSPSGLDGYVDDYLSDSDRLEASNRIEAALGKSRDAWSAHYNNNDKESIEKFGKLFGDRFPSYG

SEQ ID NO: 4457 - protein, 186 aa, Photobacterium angustum
MPYTIPVSFDKFIEKISVTGNQAEIAESRCKSIVSMLDKELNILEAFPFGSLVSGTSLCGFADADVMLVLHYGDHAENNSPTEFLQSVRDKLSRYNTRMAKKNGQAITLYFKTWPNVDIVPAYRVSDNGSFYCYKIPNANDDSWIETSPKIHINSMQNVCEQKNPFNQNDQRMEQKALFIFIILSY

SEQ ID NO: 4458 - protein, 283 aa, Vibrio crassostreae
MPYTIPVSFDKFIERISITGNQVDTAESRCKSIVSLLDKDFSILDAFPLGSLVSGTSLSGFADADVMLVLHYGTHAENKSPTELLQSVRDKLCEYNTRMAKKNGQAVTLYFKTWPNVDIVPAYRVSDNGSFYCYKIPNANDDTWIETRPKIHINNMKKVSEKKVHLIKMIKEWNRKHSSYLSSFHIEVMALSYEDFHGDYAWHVFKFFEHMHTKIQSHIPSPSGLDGYVDDYLSYSDRLAASSRIETALAKSRDAWLTHYNNNDKEAIEKFGKLFGDRFPSYG

SEQ ID NO: 4459 - protein, 283 aa, Shewanella sp.
MPYTVPVSFDKFIENISVSGNQSETANSRSQSIVNLLDKDFSILEAFPIGSLVSGTSLKGYADADVMLVLHFGNHIDGKSPTQVLQAVRDKLSEYNTRMAKKNGQAVTLYFKTWPNVDIVPAYRVTDNGTFYCYKIPNMNDDTWIETRPKIHIKNMKAVSSSKINLVKMIKEWNRKHSSYLSSFHIEVMALSYEDFYEDYAWHTFKFFEHMYDKTQYRIPAPSGLGGYVDDYLGYADRQEARKRIEIALGNSRNAWSDSYNNRDKDSIEGFGRLFGERFPSYG

SEQ ID NO: 4460 - protein, 325 aa, Bacillus cereus
MADITKSINQFITDEIKLFKEDISSAVTSREWFLNRIKNAIQNRENEPVLYSTNFVKFGSYFKGTKVTNVDEFDVLVVIDSRSGEYKVDGNVIGKGLGNANPNHKYDKKYKKSDNSGVSPSKLLNWLKGIVEEVVESFQGQAPERDGQAITATIKSKDLKIDLVPAGIFEEDDGTVFYIIPKGDKGNGWIKTQPKDDMKELEDVAKEKEGFRNVIRLMKFIRSTYNFKVSSFAIESAIVNYGKTEPWENDLYTDFKGCLGYLAQNFRDGEIKSTIDESANLISGVVSLDYYATRIDKIIIELEKLESKPEQKVANEAVSKLFKNE

SEQ ID NO: 4461 - protein, 324 aa, Bacillus cereus
MADITKSINRFITEEIKLLKEDISSAVTSREWFLNRIKNVIQNRENEPDLHSNNFVKFGSYFKGTKVTNVDEFDVLVVIDSRSGEYKVDGNIIGKGLGNANPNYKYDKKYRKSDDSGVSPSKLLNWLKGIVEEVVKSFHGQAPERDGQAITAIIKSKNLKIDLVPAGIFEEDGTVFYIIPKGDKGNGWIRTQPKDDMKKLEDVAKEKAGFRNVIRLLKFLRSAYNFKVSSFAIESAVVNYGKTELWKNDLYTDLKGCLVYLAQNFRDGEIKSTIDEKANLISDVVSLDYYATRIDKIVTVLGNLESEQDQKVANEEVSKIFKNE

SEQ ID NO: 4462 - protein, 325 aa, Bacillus cereus
MADITKSINQFITDEIKLFQKDITSAVESREWFLSRIESAVKKRTNEPTLYKTPFVYFGSYFKKTKVTNVDEFDVLVVIDSNSGQYTQGGQVIGKGLGDANPNHKYDKKYKKSDDSGVSPSKLLNWLKGIAEEVVESFHGQAPERDGQAITATIKSKGLKIDLVPACIFEEDDGTVFYIIPKGDKGNGWIRTQPKDDMNELEDAAKEKDGFRNVIRLMKFVRGKYNFKVSSFAIESAVVNYSKTATWKNDLYTDLKGFLSYLAQNFRAGEIKSTIDENANLISGVENLAYYASRIDKIITTLGDLEGESDQKVANEAVSKLFKNE

SEQ ID NO: 4463 - protein, 358 aa, Candidatus Omnitrophus fodinae
MNMNNSYSDALLASILKGTVSNAFEGLLTKNINIDKGIRGRASTSQNHLRDFLSSQHKSDPTFPRVLSKADQDFLGGSFDRHTKNWPLDDIDIYFPLDGYNLWYIQNYSRLPYTVMSDHVLAGNPLLGTKWSVGGMISSSKLIEGFATVLKNRYSRTEVKPNGQAVSLRMSLGETESEDGLGYDIVPCFFLKPDNFLEDAFYLIPDGNNGWIRTNPKIDSKITANLHVKNNETFRKVVKIIKYWNSEMLSGTFNSYYIELAIARGYESQNQAGKTINTLPFGIALGFWALNQAAKQGAQQPWLAGAPSVPSGTTKITDLEYLDNVQRYSEIAWDDELAERYDEALKKWKIIFGVSFGN

SEQ ID NO: 4464 - protein, 287 aa, Desulfobacula sp.
MSRKIATAFNKFYRNIKISKEYRKIAYQRKNEILPILKDKLNVVEFISTGSVPRNTALYKNADFDLIVVFDYGQKIKNIKPAEVLQSICEIFNDSDIKATTNGQTVTLHYETLPNIDITPALKIFDNEKSIKTCNIPDSTSKKWIQTKPNQHTRDMINEHLICGTSFRKIIMIVKHWNQMRGSYLQSYHIEVMALKIFHFKLENIAWEIFYYFEKAADLISKPLWHEGILVDSYLNPKNRFEIRTMMQNDRDSLFAAWQKIQNIDSGYIEAFTIWKKIFGEKFPDCK

SEQ ID NO: 4465 - protein, 327 aa, Bacteroidetes bacterium
MTLLQSIDQMIDNITVTDRQEDNIKASISNLNDHLKAKESNLHVLETFTNGSYERDTIIRPLKDIDLFAVLDLEKWKDENGNLPNPQSVLSKLKEYLNGLNDYKDKVRQDRPCVTIELSNKDFDVLPSFEQNGSYLIPAYDLKSWTYSDPKRLTDDLSKVNGQRSYRVKPTIKAVKYWNRENNGFVPSYHIEEVAISIFQMYSVKNYEESIRLWFDNASLYLNSQKFDSYNKYEKAISKIGKVKDKLTEAKKDFDNGEERKAKELWKSVFGDEFPDVVDEEVEEAKTFAKSLSSGALKISAAGTLSVAVGNTVAASKGFYGDDLPNT

SEQ ID NO: 4466 - protein, 322 aa, Maribacter sp.
MATLLQKIKEMIDNISVTDKQEDTINTATNNLSNHLTRDENDLDIDSTFVNGSYERDTMVRPLDDVDVFAVLNKDEWTDDYGNLPKPQAVLSKIKNKLNSISDYKDKVTQDRPCVTVTLKAINFDVLPSFEESFGGYLIPNYDLESWTYSYPEQLTNNLNDSHRNNDYKLKDVIKAVKYWNRENKKLIPSFQIEETMISYFNVNKITNYEEAIRLWFNNAEYYLEKNKFKTNNQYDDAIKKIKSVRDKLNKAKEHTDNKENDEAIQIWKDVFGKEFRLSDVEEAKAFSKKLSEGSLKAASTGAISSSVGRNIPASKGFYGDL

SEQ ID NO: 4467 - protein, 323 aa, Bacteroidetes bacterium
MATLLQSIDQLIDNISVTDRQEENIKNSVSNLDSNLKNSDNNLYVERTFTNGSYERDTIIRPLNDVDIFAVLKRDDWKDEYDNLPNPQNVLTRIKNYLNSLNDYKDKVFQSRPCVTIELSDKDFDVLPSFAQLGGGYLIPNSDLKSWTYSYPEQLTTDLNNTHKSCNYKLKQIIKAVKYWNRENSKIIPSYHIEEAAINIFKINSFKNFEEAIRLWFNNAEYNLISQKFKSNDDYTASVNKIKKVKDKLNNAKKLYDENNEIEAIKIWKEIFGKEFPTVDMDEAKNFSKSLSEGSLKVSSAGILSTTIGKSVSASKGFYGDIS

SEQ ID NO: 4468 - protein, 324 aa, Sphingobacteriales bacterium
MTLLECISGLIDNISVTDRQEDNIKGSLSNLEGHLKDEDNDLHVTKTFTNGSYERDTIIRPLNDIDLFAVLDREAWKDECGNLPNPQSVLTKIKNYLNDQPDYKDKVSQDRPCVTVKLSDKNFDVLPSFEEIGGGYLIPKYDLKSWTYSYPEQLTTNLDNIHRQRSYKVKPTIKAIKYWNREKGKLIPSYHIEESVINIFSLNDFTNFEQSIRLWFNNAEYHLQSNKFKSNDDYTTSINRIEKVKEKLNEAKEKYDDGKEDEAIQIWKDIFGKEFPTVDEDESKNFSKSLSEGSLKISGTGTLSTTVGTAISASKGFFGDIPKE

SEQ ID NO: 4469 - protein, 324 aa, Bacteroidetes bacterium
MTLLESIKKLVDNVTITDRQEENIKNSLSNLASHLKDKESNLNVKECFTNGSWERDTIIRPLNDVDLFAVLDFEKWKDEYGNKPNPQSVLTKIKNYLNEQNDYKDKVNQNRPCVTVHLSDKDFDVLPSFEIAGGGYYIPNYDLKTWTTSYPKSLTKDLDDTHKLRNYNLKQVIRVVKYWNRDFNGKTIPSYHVEEIAINIFKLNNFTNFEEGIRKWFENVEYNMQSNKFKSNDEYESSLKKAKKVKDKLNEAYKFYTDKNEVEAKKIWKDIFGKEFPTVDEEEAKNISKSLTEGTLKYSSAAGISTTVGNSLSASKGFYGDEIL

SEQ ID NO: 4470 - protein, 325 aa, Chitinophagaceae bacterium
MPTLLQCINTLIENISVSDRQETNIKASVSNIGGYLNDKENDLSISRTFTNGSYERDTNIRPLDDIDIFAVLKRDDWKDEYDQLPNPQSVLSKFKNYLNGLNDYKDKVSQNRPCVTIELSDKDFDILPSFELVGGGYEIPNHDLKSWIKTYPELLSSDLEATHKKCDYKLKPLIKVIKYWNRDKGKLIPSFHIEEVAINIFKINSFKNYEECIRLWFNNAEYNLQSYELNSNEEYNAILKKIKSVRDKLNDAKGKYDEGKEGDAIQIWKDVFGKEFPTVDIEEAKQFSKSLSEGSLKVSSSGLLSTNVGKAVSSSKGFFGGISND

SEQ ID NO: 4471 - protein, 324 aa, Flavobacterium psychrophilum
MATLLQCVKILIDNITISDRQEENIDKSVSNINTHLLKEESNLKVKKIFLNGSYERDTIIRPLNDIDLFAVLKKEDWQDENYNYPNPQSVLTKFKNYLNNLNDYKGKVSQDRPCVTIHLSDKDFDILPSFDTGTQTYLIPNYELTGWTTTNPEILSSNLNAAHKNYNYNLKQIIRVIKHWNRDSNYKTIPSYHIEEVSINISNLIQFENFEQGIRKWFEYAETYMMATKFKSFDEYTKSLNRLKKVKDKLIDAKKLIDDKKQGEAIQIWKEIFGKEFPTIDIEEAKSFSKSISEGSLKISSTGALSESIGKNITKSTGYFGELH

SEQ ID NO: 4472 - protein, 355 aa, Sphingobacterium thalpophilum
MLLKLSFLQSSAKNTFSITYTSICKILKKIHMTLLQAINRFIDNISVTDRQESSIRTSLDNINYYLKNKDNSLHVKRTFTNGSYERDTIIRPLNDIDIFAVLDIEKWKDDFGLLPTPQDVLTAIKDYLNDVPDYKGKVKQDRPCVTVKLSDKHFDILPCFELYGEGYQIPNHDLSGWTYSYPEKLQTDLDNIHKERGYKVKSIIKAIKYWNRDLDKLIPSYHIEEAAIDIFSFYGFKSFQEGIELWFEHAGTYLVSAKFKSYRQYEKAIEKVNNVVTKLEKAAEKCGEGEETEALLIWKDIFGKDFPTIDPEEAKNFSKAISEGTLKVAGTGLLSTVSGYSITASRGYHGGLSKE

SEQ ID NO: 4473 - protein, 324 aa, Olivibacter sitiensis
MTLSQAINRFIDNISVTDRQEGNIKGSLDNIYYYLKKKDNGLQVKRTFTNGSYERDTIIRPLDDIDVFAVLDIEEWRDDYGRLPSPQNVLTAIKDYLNGVPDYKDKVKQDRPCVTIKLSDKHFDILPCFETYGGGYQIPNYDLSGWTYSYPEQLQANLDAIHKERNYKVKQVVKALKYWNRDLDKLIPSYHIEETAITIFSFYGFKNFQEGIELWFKHAGFYLESSKFKSYRRYEKTIEQVDKAVNKLEEASEKCEENKETEALLLWKDIFGRDFPTIDPEEAKNFSKAISEGTLKVAATGFLSTVSGHPINASRGYYGGLSKA

SEQ ID NO: 4474 - protein, 321 aa, Capnocytophaga sputigena
MNLLQSISKLIEKISITDKQEENIKASVKNITTTLEKDDTLHLKETFLNGSYERDTMIRPLDDIDIFVVLDESYWKDDFGVMRKPQSVLDKIKDFLNDQNDYKGKVRQDRPCVTVELSNKSFDILPAFEQIEGYLMPNYNLESWIPTYPKILTENLKNAHRDYSYKLKDIIRVIKYWNKLNGKMIPSFHIEEVAIKIFKFKIFENFEKSIREWFEKAECNLEINKFKSNTQYDDFKNKLNRTKTKLQNAKEFLDKNNQYEAKKIWKDVFGKEFPTVNEEEAKLFSKHLSEGTLKATSIGLLSTTLGKTMAASKGFYGEEIF

SEQ ID NO: 4475 - protein, 257 aa, Vibrio alginolyticus
MYSMYSQPRTGLQSKFEKFRENIELTQGQKDKIISSHTHLRQRNLQPLNYVKESFLTGSYKRNTMIRPLSDVDAFVVINKNYNETTPNAVLAQLKRDLNSSYPNSVIRQDKPCVTLDFAHCKIELTPAIPAGYYPEQGYYIPKQGTNEWMLTDDPKRAESRLSQANTRLNGKLTPLIKMIKHAKNNNNIRDIKSYEIEDIAIRNVSYMSNYRDGVQQMFRCLGWTVNNMNQFQLEQLSEQEFAKLCRTSIFGCDFPE

SEQ ID NO: 4476 - protein, 257 aa, Vibrio parahaemolyticus
MYSMCSQPRTGLQSKFEKFRENIELTQGQKDKIISSHTHLRQRNLQPLHYVKESFLTGSYKRNTMIRPLSDVDAFVVINKNYNETTPNAVLAQLKRDLNSSYPNSVIRQDKPCVTLDFAHCKIELTPAIPAGYYPEQGYYIPKQGTNEWMLTDDPKRAESRLSQANTRVNGKLTPLIKMIKHAKNNNNIRDIKSYEIEDIAIRNVSYMSNYRDGVQQMFRCLGWTVNNMNQFQLEQLSDQEFAKICRTSIFGCDFPE

SEQ ID NO: 4477 - protein, 257 aa, Aliivibrio fischeri
MYSMYSQPRTGLQSKFEKFRENIELTQGQKDKIISSHTHLRQRNLQPLHYVKESFLTGSYKRNTMIRPPSDVDAFVVINKNYYETTPNAVLAQLKRDLNSSYPNSVIRQDKPCVTLDFTHCKIELTPAIPASYYLEQRYYIPKQGTNEWMLTDDPKRAESRLSQANTRVDGKLTPLIKMIKHAKNNNNIHDIKSYQIEDIAIQNVSYMTNYRDGVQQMFRCLGWRVNNMNQFQLEQLSDQEFAKLCRTSIFGCDFPE

SEQ ID NO: 4478 - protein, 257 aa, Vibrio parahaemolyticus
MYTMYSQPRTGLQSKFEIFRENIELTQTQKERIISSHTHLRQRNLQPLFYVKESFLTGSYKRNTMIRPPNDVDAFVVINKSTYETTPNAILSQLKRDLNGCYPNSIIRQDKPCVTLDFNHCKIELTPAILAGYCPEQGYYIPKQGTNEWMLTDDPKRAEARLSQANTWLNGKLTPLIKMIKHAKQINNIKNVKSYQIEDLAIQNIRTMSNYRDGVQQMLRALGWTVNNMSQYQLEQLSDCAFAELCRSSIFGNEFPV

SEQ ID NO: 4479 - protein, 257 aa, Vibrio sp.
MYTMYSQPRTGLQSKFEMFRENIELTQTQKEKIISSHTHLRQRNLQPLFYVKESFLTGSYKRNTMIRPPSDVDAFVVINKSTYETTPNAILAQLKRDLNGCYPNSIIRQDKPCVTLDFNHCKIELTPAILAGYYPEQGYYIPKQGTNEWMLTDDPKRAETRLSQANSRLNGKLTPLIKMIKHAKQINNIKDVKSYQIEDLAIQNIRTMSSYRDGVQQMFRALGWTVNNMSQFQLEQLSDFAFAELCRSSIFGNEFPA

SEQ ID NO: 4480 - protein, 257 aa, Marinomonas sp.
MYSMYNQERTGLQSKFEQFTSNIELTNSQKEKIISSHTHLRQNNLQPLFYVNESFLIGSYKKNTMVRPPSDVDAFLVINKDRYSITPNAVLNQLKRDLNNSYPNSKIRQDKPCIVLDFNHCKIELTPAIMSGFRKEQGFYIPKSGGNEWMFTEDPKKQESMLSQANSRVNGKLTPLIKMMKVCKKFNNISDIKSHEIEEIGIRNIYSISNYRDGIQKILRALDWTVRGTSYYELESLSDHEFAKICRSSIFGTDFPE

SEQ ID NO: 4481 - protein, 257 aa, Moritella viscosa
MYSMRAQQRTGLQSKFETLSSNIELTASQKEKIISSHIHLRQINLQPLFYVKESFLLGSYKKNTMIRPPSDVDAFLVVNKDRYSVTPNAVLNQLKRDLNNSYPNSKVRQDKPCVVLDFNHCKIELTPAIMAGFYGEQGFYIPKPGRNEWMLTDDPRKQETVLSQANSRVNGKLTPLIKMMKVCKKFNNINDIKSHEIEEIAIRNIYSMTNYRDGLQKMLRALDWTVRGYSTFELEALNDHEFATVCRSSIFGTDFPE

SEQ ID NO: 4482 - protein, 250 aa, Vibrio quintilis
MVEQSAELSAQFEQFLQHIALTDAQESEINSRFAAIRDQLKQLPYVTECFITGGYKKKTLIQPACDVDLFVVMSSEQRDVVPHVVLNQLKHDLHHVWPDSVLRLDKMCMAINFDHCRFELVPAVMVGDHHELGFYIPLATNNNDWSYVGSPQISETRLIAADAKLDGKLLPLLRMMKYCKYQNKINNISSYQMEQAALETFEFIRSYREGIQELLRVYGWVDSPYHLQSMADSEFGEFCRNMLFGQDFPV

SEQ ID NO: 4483 - protein, 250 aa, Vibrio aerogenes
MVEQSAELSAQFEQFLQHIALTETQEAEISDCFAAIRHQLKQLPYVTDCFITGGYKKQTLIESACDVDLFVVMSSEQRDIVPHVVLNQLKHDLHHVWPDSVLRLDKMCMALNFDHCRFELVPAVMVGDHHELGFYIPLASNHNDWSYVGSPQISETQLIAADAKLDGKLLPLLRMMKYCKHQNKISNISSYQMEQVALETFEFIRSYREGVQELLRVYGWVDSPYHLQSMADSEFGEFCRNMLFGKAFPV

SEQ ID NO: 4484 - protein, 308 aa, Mycoplasma sp.
MVKTLTEDFETFIDTISLDKKLKNDIIDKHTSLTNMIQEDHPDGYNINRTRISGSYGKDTEINEFDPNKNPDVDIVVILDTDLDNVEQINKDFYDYLVDKKASVVQEVRQQSNSIGLKYKNIDVDIVLAKDNEDGSIKITSDKKQTWIDSNCLRQIDYMTEQNKKYTTFGYKKLMKLFKYLNKEVLNNKIKSYTLEMLVHQCVPTNRVDLKIWNAFSETLGNIAELKNIEDIKDCCDSSKKGYDDKDKNGFIYFKEEINELYKKSLDAINGDRKKWEEIFGSRFPEQPVKKVENNNQYDKKQTPWCYK

SEQ ID NO: 4485 - protein, 308 aa, Mycoplasma sp.; identical to SEQ ID NO: 4484

SEQ ID NO: 4486 - protein, 254 aa, Winogradskyella sp.
MSVLSYLTDLSSSITISDWERTSIDTSINTLSTKLGNYFDNIESKFVFGSYDRKTILRRSKDSNSDVDFLVSFKDGSEWTPQTLMNRLKRFAEANYSKNEIYQSSPTIVLELSHIKFELVPAWGTFNIPAPASIYTTWIGTYPLTFKDKLNDKNRDNNYQIRKLIRLLKYWNVLNYRVYSSYEIEEYVVGKFFFLCYNLKDYFFQAVEGLPTYNLPEYKQNKVDRLKKIVAETKENERQGWNALAEIEIKKAFE

SEQ ID NO: 4487 - protein, 254 aa, Winogradskyella sp.; identical to SEQ ID NO: 4486

SEQ ID NO: 4488 - protein, 254 aa, Winogradskyella thalassocola
MSVLSYLTDLSSSITIADWERNSIDTSINTLSTKLGNYFDNIASKFVFGSYDRRTILRRSKDSNSDIDFMVCFTDGNEWTPQTLMNRLKRFAVANYSKNEIYQSSPTIVLELSHIKFELVPAWGTYNIPAPASSYTTWIGTYPLTFKGQLNDKNRDNNYQIRKLIRLLKYWNVMNYKVYSSYELEKYVIDKYFYFCTNLKDYFYLAVEGLPTYDLPEYKKAKVERLKNIVKSTKENENGGWYALAEIEIKKAFE

SEQ ID NO: 4489 - protein, 258 aa, Nonlabens ulvanivorans
MSVLSYLNELSSTITIPDWERTTIDTSINSLSTKLGNYFDNIESKFVFGSFDRKTILRRSRDSNSDVDYMISFTDGADWTPQTLMNRLKRFAEANYSKNEIYQSSPTIVLVLGHIKFELVPAYHTWGGTYHIPAPASSYSTWIDSYPNAMRKNLNDKNRDNNYEIRKLVRLLKYWNVLNGKVYSSYELEKYVIDKFFYFCTNQKEYFFQAVEGLPTYGLPYYKESKVNSLKTKVANTKKYEQDNMPYTAESEIKKVFE

SEQ ID NO: 4490 - protein, 258 aa, Nonlabens ulvanivorans; identical to SEQ ID NO: 4489

SEQ ID NO: 4491 - protein, 257 aa, Zunongwangia mangrovi
MSVLTYLTDLSKTITIPDWERNSTNTSITTLSYKLGNYFNKIESKFVFGSYDRKTILRRSRDSDSDVDFMVSFENGSSWTPQTLMNRLKRFAEANYSRNEIYQSSPTIVLELSHIKFELVPAYYTWGTYHIPAPASSFSQWTNTYPHALKKDLNDKNKANYYLIRKLVRLLKYWNVINYKVYTSYELEKYVIDKYYLASYNLKDYFYDAVAGLPTYGLSSYKEDKVLRLKRIVNEARENERQGWNYLAEEEIKKAFG

SEQ ID NO: 4492 - protein, 270 aa, Clostridium sp.
MATVNGYLTSLQSDLYVNGAEKDKIKTSIDAICTRLGYYFGNPEHNIHKIIKKDIFGSYSRDTMLSRKYDEDSDIDLMVIFEDANEYTPQTCLNWLKGFADYWYPNSLVKQSLPTIVIELQNIKFELVPAYKNDYGNLYIAKDSSNWQYTNPKDLNDKMNKLNGTTNYEFKRIIRTIKYWNVKKNYRRYKSYSLEKYLTEKFETSYLYCNNQFDYLDWAFFHLGNYSTNDDYISNRIKTAKDNIELAQKYEKNYDYDLAIECIKRVIPKT

SEQ ID NO: 4493 - protein, 270 aa, Clostridium sp.; identical to SEQ ID NO: 4492

SEQ ID NO: 4494 - protein, 263 aa, Persicobacter sp.
MSVLSHLNTLGSNLVLSSSETSSINTSITTLEKRLGYYFDNIKSSFVFGSFDRSTILPRSVDENSDIDYMIVFNDGVDFKPQTLLARLKRFAETYYSTSEIYQSSPTLVLNLNHIKFELVPAYENWWSLYIPAPASDYQDWISTDPNQMKANLTDKNGNNDYKIKPLIRVLKYWNVLNYKVYSSYELEKYIIDKSYNWCDNLKDYFFSAVDGLPTYRLPDYKRNKVERLQRNISEVKELLDGGMPFSAEIKLKEELPDCHILK

SEQ ID NO: 4495 - protein, 260 aa, Herpetosiphon geysericola
MSVLSHLDKLARDLNIAENEAFKINRSLTTLESRIDRYFVNDVKQRFRFGSSVRKTMLPRIADQTSDVDYMVVFDNSNNYKPQTFMTKLKNFATTYYGSSEIYQSSPTIVLELEHIKFELVPSYKSGIGFYIPAPRTAYTDWLYSDPTGFNADVDSANINTKFLMKPSIRLIKYWNARNGIYSSYELEKTVIGTQYSYCNNVKEYFFLAVNLLPTYGLTETNKRKVEGFKLKINEIKNNERNGLLLTAENEIKSLLPSIN

SEQ ID NO: 4496 - protein, 269 aa, Halonatronum saccharophilum
MSVNSYLTDLASKLVLKGSEKASIITSIATLEKRLTYYFGKDIKEQFYFGSYTRGTILPRKADDNSDIDYMIVFDNSNNYKPQTYLNKLKSFANNSYSTSEIFQSHPTIVLELNHIKFELVPAYNAGGIWFKDYKIPAPSNILSEWTFTNPNGFNESLTQANKGNNYNIKPVVRLIKYWNAQNGYIYRSFELEQSIIYNSNRYIYYGCSSLRDYFYKTVENLSTCGLSQTLANKVRKLKQSVGKVKQLEEIGCTGDAEKRLKSILPELR

SEQ ID NO: 4497 - protein, 214 aa, Halonatronum saccharophilum
MSVNSYLTDLASKLVLKGSEKASIITSIATLEKRLTYYFGKDIKEQFYFGSYTRGTILPRKADDNSDIDYMIVFDNSNNYKPQTYLNKLKSFANNSYSTSEIFQSHPTIVLELNHIKFELVPAYNAGGIWFKDYKIPAPSNILSEWTFTNPNGFNESLTQANKGNNYNIKPVVRLIKYWNAQNGYIYRSFELEQSIIYNSNRYIYYGCSSLRDY

SEQ ID NO: 4498 - protein, 264 aa, Unknown
  Description of Unknown: uncultured Clostridium sp. sequence
MSINGYLTTLASSLIIRDSEKESIARSISTLQTRLNLYFKDEIEEQFCFGSYTRGTILPRKADESSDIDYMIVFKNSEGYMPQTFFRKLKEFANHWYGSSEIYRDSPTIVLELKHIKFELVPAYSSLSYWSKQYYIPAPRATHINWIQTDPNEFNSKIKNKNVKEQSIIKPLVRLLKYWNTRNGHVYSSYELEQHIIDQGYWFENNLRDYFYKAVASLQTFGLNSTDTNKVNSFKNKVEQIRDYEQRGYEPYAESELKILLPNI

SEQ ID NO: 4499 - protein, 263 aa, Haemophilus massiliensis
MTVSSYLNDLSEKLIIRDSEKDSIRRSFSALESRLSNYFGSGIGFVRKFGSYHRETILPRDYDFNSDVDVLVEFTDKSYKPQTYLNKLKRFAEYWYSRSEIYQSSPTIVLELNHIKFELVPCIEAEWYEGGNYKIPSKASDYQEWLLTSPFEFNDELTRKNKVFDYKIKPLIRILKRWNGNTRYSKVYDSFKLEEKIVSHGFSYLDSSLKDYFFDFVMSMNGFDLPDYKREEVKKLVNKIKEIQRDEHKYPIWAENELRKFFD

SEQ ID NO: 4500 - protein, 264 aa, Haemophilus haemoglobinophilus
MTVSSYLNNLADNLMIRDNEKDSIRKSFDVLVYRLNNYFGEDIGFVRTFGSSHRETILPREYDPNSDVDVLVKFTNRLYKPQTYLNKLREFAEYWYSRSEIYQSNPTIVLELNHIKFELVPCLDASWYENGNYKIPSKASDYQEWLLTSPFDFHDELIKINKKFDYKIKPLIRVIKRWNTNTRYSKIYDSFKSEEKIVNYGFSYVNNSLKDYFFDFVINMNISDLIYKYQREEVKKLVAKIKEIQRYEKEYPNWAESELRKFFD

SEQ ID NO: 4501 - protein, 263 aa, Aggregatibacter actinomycetemcomitans
MTVSSYLNDLADQLIIRDSEKDSIRRSFSTLDYRLNNYFKDDIEFVRKFGSYHRETILPRDYDISSDVDVLVKFTDKSYKPQTYLNKLKQFAEHWYSHSEIYQSSPTIVLELNHIKFELVPCLDAEWYESGNYKIPSKASDYQEWLLTSPFEFNDALTRKNKIFNYKIKPLIRVLKRWNVSTRYSKIYDSFKLEEKIVNHGFSYLNSCLKDYFFDFVTNMNGFDLPDYKREEVEKLVNMVKEIQRDEDNYPIWAENELRKIFD

SEQ ID NO: 4502 - protein, 266 aa, Bacillus cereus
MSVSLYLESMASDLIIREEEDIKIERSIVFLKRNLERYFGANVKRNFLFGSYIRKTNLPRKADPKSDIDYMIVFNNANEYKPQTFLDRLRKFVNSYYSSSEIKQSHPTIVLELSHIKFELVPAYQGYISELLNEYYIPSRSSEYTDWIRTDPITFNKQVDEKHSSENYKIKPVIRLIKYWNKSAGGLFSSYELEAKISAQNYWWCSNLKDYFFKAFEALNYTWTDPQYKIDKMKNVKIIIENIKYYDERNQHLDAESYLKKLLPPL

SEQ ID NO: 4503 - protein, 266 aa, Bacillus cereus
MSVSSYLESMSSNLIIREEEDIKIERSIVFLKRNLERYFGANVKSNFLFGSYIRKTNLPRKADPKSDIDYMIVFNNANEYKPQTFLDRLRKFVNSYYSSSEIKQSHPTIVLELSHIKFELVPAYQGYISELLNEYYIPSRSSEYTDWIRTDPITFNKQVDEKHSSENYKIKPVIRLIKYWNKSAGGLFSSYELETKISAQNYWWCSNLKDYFFKAFEALNYTWTDPQYKIDKIKNAKIIIENIKYYDERNQHLDAESYLKKLLPPL

SEQ ID NO: 4504 - protein, 266 aa, Bacillus cereus
MSVSSYLENMASNLIIGEDEDIKIDRSIDYLRKNLERYFGEEVKKNFLFGSYIRKTNLPRKADSKSDIDYMILFNNANEYKPQTFLDRLRRFVNFYYSSSEIKQSHPTIVLELSHIKFELVPAYQNYFDQVLNQYNIPSRSSEYTDWIKTDPISFNKQIDEKHSSENYKIKPVIRLLKYWNKSAGGVFSSYELETKIAEQNYWWCSNLKDYFFKAFEAINYTWMDSQHKINKIKNMKITIENIKYYDERNQHFDAETYFKKLLPPL

SEQ ID NO: 4505 - protein, 259 aa, Vibrio lentus
MTVLSHLNSVSSSAVLSTAEIDSINRSIATLEARLTSYFGSDIKSKFRFGSSTRGTILPRSMDGKSDIDYMVVFNNSDFKPNTYLQRIRRFVETYYSSSEIYQSSPTIVLNLNHIRFEIVPAIESWFSGLQIPAPASDFSEWMNTDPNDFNAELTNFNVSNNSKIKPLIRLLKYWNAKNNYPFESFLLEKEVINMNFWFCTDLKDYFYTAIESLNAGFFAPQWKINAVDKAKRIVSEAKSFESQSMPYSAEAEIKKLIP

SEQ ID NO: 4506 - protein, 259 aa, Photobacterium sanguinicancri
MTVLSHLNSVSSSAVLSTAEIDSINRSIATLEARLTSYFGSDIKSKFRFGSSTRGTILPRSMDGKSDIDYMVVFNNSDFKPNTYLQRIRRFVETYYSSSEIYQSSPTIVLNLNHIRFEIVPAIESWFSGLQIPAPASDFSEWMNTDPNDFNAELTNFNVSNNSKIKPLIRLLKYWNAKNNYPFESFLLEKEVINMNFWFCTDLKDYFYTAIESLNAGFFAPQWKINAVDKAKRIVSEAKSLESQSMPYSAEAEIKKLIL

SEQ ID NO: 4507 - protein, 258 aa, Burkholderiales bacterium
MSVLSFLTNTASSAVLSSNEQSSIATSIKTLQSRVALHFDSGVIAQHFQFGSSTRGTILPRSMDEHSDIDYMVVFSDGSATPQTYLNRLKAFVEKRYGSSEIYQSSPTIVLELNHIKFELVPATRNWLGELQIPNGAGGWMTTKPNDFNATLEAKNKEHKSLIKPTIRLFKYWNATAGFPFQSFEMEKWVCSLSFWFLANQKDYFLAIIEKLNTSTSYSQWVNNEITRAKNIAANVRQYEKDEMPVTAENEIKKLFRL

SEQ ID NO: 4508 - protein, 258 aa, Massilia sp.
MSILSFLTATASSAVLSATEQSSIKTSITTLQARMALHFDSGAIAQHFRFGSSTRSTILPRSMDEKSDIDYMVVFSDASATPQTYLNRLKAFVEKRYGSSEIYQSSPTIVLELNHIKFDLVPATKNWLGGLQIPNGSGGWMATSPNDFNATLEAKNKEHNSLIKPTIRLFKYWNATAGFPFQSFEMEKWVCGLRFWFLANQKDYILAVIENLNTSTSYSQRVNNEITRAKCIVADVRRYEKDEMPVTAENEIKKLFRL

SEQ ID NO: 4509 - protein, 258 aa, Jeongeupia sp.
MSVLSFLTDTASSAVLSTTEQSSITTSITTLQSRMALHFDSGVIAQHFRFGSSTRGTILPRSMDEQSDIDYIVVFSDGSATPQTYLNRLKTFVEKRYGSSEIYQSSPTIVLELNHIKFDLVPATKTWLGELQIPNGSGGWMTTNPNDFNATLEAKNKEHKSLIKPTIRLFKYWNATAGFPFQSFEMEKWVCGLSFWFLTNQKDYFLAVIENLNTNSSYSQWVNDEITRAKNIVAKVRQCEKDQMQVTAENEIKKLFRL

SEQ ID NO: 4510 - protein, 258 aa, Unknown
  Description of Unknown: Burkholderiales sequence
MSVLSFLTDTASSAVLSTTEQSSITTSIITLQSRMALHFDSGVIAQHFRFGSSTRGTILPRSMDEQSDIDYMVVFSDGSATPQTYLNRLKTFVEKRYGSSEIYQSSPTIVLELNHIKFDLVPATKTWLGELQIPNGSGGWMTTNPNDFNATLEAKNKDNNSLIKPTIRLMKYWNAASGFPFDSFAMEKWICGQGFWFQSNQKDYLFSVIDNLSTDSSYSQRVNNEITRAKTIVAKVRQCEKDQMPVTAENEVKKLFRL

SEQ ID NO: 4511 - protein, 258 aa, Cupriavidus sp.
MSVLSFLTDTASSAVLSTTEQSSITTSITTLQSRMALHFDSGVIAQHFRFGSSTRGTILPRSMDEQSDIDYMVVFSDGSATPQTYLNRLKTFVEKRYGSSEIYQSSPTIVLELNHIKFDLVPATKTWLGELQIPNGSGGWMTTNPNDFNATLEAKNKDNNSLIKPTIRLMKYWNAASGFPFDSFAMEKWICGQGFWFQSNQKDYLFSVIDNLSTDSSYSQRVNNEITRAKTIVAKVRQCEKDQMPVTAENEVKKLFRL

SEQ ID NO: 4512 - protein, 258 aa, Delftia sp.
MSVLSFLTNTASSAVLPATEQSSITTSITTLQSRMGLHFDSSAIAQHFRFGSSTRGTILPRSMDEQSDIDYMVVFSDGSATPQTYLNRLKSFVEKRYGSSEIYQSNPTIVLELNHIKFDLVPATKTWLGELQIPNAAGGWMTTNPNDFNATLDAKNKEHKSLIKPTVRLFKYWNATAGFPFQSYEMEKWVCGLSFWFLANQNDYFLAVIESLNTSTSYSQRANNEITRAKNIVANVRRYEKDEMPVTAENEIKKLFRL

SEQ ID NO: 4513 - protein, 258 aa, Aquabacterium parvum
MSVLSFLTDTASRAVLSSTEQSSISTSIKTLQSRMALHFDSSAIAQHFRFGSSTRGTILARSMDEQSDIDYMVVFSDSSATPQTYLNRLKSFVEKRYVSSEIYQSSPTIVLELNHIKFDLVPATKTWLGELQIPNGSGGWMTTNPNDFNATLEAKNKDNKSLIKPTIRLFKYWNATAGFPFPSFEMEKWVCGLNFWFLTNQKDYFLAVIENLSTSTSYSQWVNNEITRARNVVANVRQFEKDDMPVTAENEIKKLFRL

SEQ ID NO: 4514 - protein, 258 aa, Massilia putida
MSVLNFLTDMASNAVLSSSEQSSITTSITTLQSRMALHFDSGVIKQHFRFGSSTRGTILPRSMDEHSDIDYMIVFSDNTATPQTYLNRLKTFVEKRYGSSEIYQSSPTIVLELNHIKFDLVPATTTWLGELQIPNGSGGWIATNPNDFNATLEAKNKEHKSLIKPTIRLFKYWNATSGLPFESFMMEKWVCGLSFWWLTNQKDYFFAVVDKLNTSSSYSQWVNNEITRAKNIVANVRQYEKDDMPVSAENEIKKLFRL

SEQ ID NO: 4515 - protein, 258 aa, Cardiobacterium hominis
MSVLSFLTDTASSAVLSTAEQSLITTSISTLQTRLGQHFSSGVIKQHFRFGSSTRGTILPRSMDERSDIDYMIVFSENNATPQTYLNRLKAFVEKYYKSSDIRQSSPTIVLELNHIKFDLVPATTTWLGELQIPNGSGGWMTTNPNDFNATLEAKNKDNNSLIKPTIRLMKYWNAASGFPFDSFAMEKWICGQGFWFQSNQKDYLFSVIDNLSTDSSYSQRVNNEITRAKTIVTKVRQCEKDQMPVTAENEIKKLFRL

SEQ ID NO: 4516 - protein, 259 aa, Eikenella corrodens
MSVLSFLTDTASSAVLSTAEQSLITTSISTLQTRLGQHFSSGVIKQHFRFGSSTRGTILPRSMDERSDIDYMIVFSENNATPQTYLNRLKAFVENYYKSSDIRQSSPTIVLELNHIKFDLVPATTTWLGELQIPDGSGSWMTTNPNDFNATLEAKNKENKSLIKPSIRLFKYWNATAGFPFRSSFEMEKWVCSLSFWFQANQKDYFFTVIDNLNTSSSYAQWVNDEITRAKTIVANVRQYEKDEMPVTAENEIKKLFRL

SEQ ID NO: 4517 - protein, 259 aa, Unknown
  Description of Unknown: Eikenella sequence
MSVLSFLTDTASSAVLSTAEQSLITTSISTLQTRLGQHFSSGVIKQHFRFGSSTRGTILPRSMDERSDIDYMIVFSENNATPQTYLNRLKAFVEKYYKSSDIRQSSPTIVLELNHIKFDLVPATTTWLGELQIPDGSGSWMTTNPNDFNATLEAKNKENKSLIKPSIRLFKYWNATAGFPFRSSFEMEKWVCSLSFWFQANQKDYFFTVIDNLNTSSSYAQWVNDEITRAKTIVANVRQYEKDEMPVTAENEIKKLFRL

SEQ ID NO: 4518 - protein, 259 aa, Eikenella corrodens
MSVLSFLTDTASRAVLSTAEQSLITTSISTLQTRLSQHFSSGVIKQHFRFGSSTRGTILPRSMDERSDIDYMIVFSENNATPQTYLNRLKAFVEKYYKSSDIRQSSPTIVLELNHIKFDLVPATTTWLGELQIPDGSGSWMTTNPNDFNATLEAKNKENKSLIKPSIRLFKYWNATAGFPFRSSFEMEKWVCSLSFWFQANQKDYFFTVIDNLNTSSSYAQWVNDEITRAKTIVANVRQYEKDEMPVTAENEIKKLFRL

SEQ ID NO: 4519 - protein, 259 aa, Stenotrophomonas maltophilia
MSVLSFLTDTASSAVLSTAEQSSITTSISTLQTRLGQHFSSGVIKQHFRFGSSTRGTILPRSMDERSDIDYMIVFSENNATPQTYLNRLKAFVEKYYKSSDIRQSSPTIVLELNHIKFDLVPATTTWLGELQIPDGSGSWMTTNPNDFNATLEAKNKENKSLIKPSIRLFKYWNATAGFPFRSSFEMEKWVCGLSFWFPVNQKDYFFAVIDNLNTSSSYTQWVNDEISRAKTIVANVRQYEKDEMPVTAENEIKKLFRL

SEQ ID NO: 4520 - protein, 259 aa, Acidovorax sp.
MSVLSFLTDTASSAVLSTTEQSSITTSISTLQTRIGQHFASGVIKQHFRFGSSTRGTILPRSMDERSDIDYMIVFSENNATSQTYLNRLKAFVEKYYSSSDIRQSSPTIVLELNHIKFDLVPATTTWLGELQIPDGSGSWMTTNPNDFNATLEAKNKENKSLIKPSIRLFKYWNATAGFPFRSSFEMEKWVCGLSFWFQANQKDYFFAVIDNLNTSSSYAQWVNDEITRAKTIVANVRQYEKDEMPVTAENEIKKLFRL

SEQ ID NO: 4521 - protein, 258 aa, Variovorax sp.
MSVLSFLTDTASNAVLSSTEQSSITTSISTLQARIGLHFTSGVIKQHFRFGSSTRGTILPRSMDEHSDIDYMIVFSENNATPQTYLNRLKTFVEKYYSSSEIRQSSPTIVLELNHIKFDLVPATSTWLGELQIPNGSGGWMTTNPNDFNATLEAKNKEHKSLIKPSIRLFKYWNATAGFPFQSFEMEKWVCGLSFWFLSNQKDYFLTVIENLTTSSSYSQWVNNEITRARTIVANVRQYEKDDMPVTAENEIKKLFRL

SEQ ID NO: 4522 - protein, 258 aa, Ralstonia solanacearum
MSVLSFLTDTTSNAVLSSTEQSSITTSISTLQTRIGQHFASSVIKRHFRFGSSTRGTILPRSMDEHSDIDYMIVFSENNATPQTYLNRLKTFVEKYYGSSEIRQSSPTIVLELNHIKFDLVPATMAWLGGLQIPNTSDGWMTTNPNDFNSTLEAKNKDHKSLIKPTIRLFKYWNATAGFPFQSFEMEKWVCGLNFWFLSNQKDYFLAVIENLNTNSSYSQWVNNEITRAKSIVANVKQYEKDDMPVTAENEIKKLFRL

SEQ ID NO: 4523 - protein, 259 aa, Burkholderia pseudomallei
MSVLSFLTDTASNAVLSSAEQSSIVTSISTLQSRIGLHFASGVIQQHFRFGSSTRGTILPRLMDDRSDIDYMIVFSENNATPQTYLNRLKAFVEKYYRSSEIRQSSPTIVLELNHIKFDLVPATRTWLGELQIPSGSGGWMTTNPNDFNATLENKNKENGSLIKPTIRLFKYWNATSGFPFESFEMEKWVCGLSFWWLAKNQKDYFFSVIENLNTNWSYSQWVNNEITRAKNIVTSARQYEKSDMPATAESEIKKLFRL

SEQ ID NO: 4524 - protein, 259 aa, Burkholderia pseudomallei
MSVLSFLTDTASNAVLSSAEQSSIATSISTLQSRIGLHFASGVIQQHFRFGSSTRGTILPRSMDERSDIDYMIVFSENNATPQTYLNRLKAFVEKYYRSSEIRQSSPTIVLELNHIKFDLVPATRTWFGELQIPNGSGGWMTTNPNDFNATLENKNKEHGSLIKPAIRLFKYWNATSGFPFESFEMEKWVCGLSFWWLTKNQKDYFFSIIDNLNTNWSYSQWVNNEVTRAKNLVTSVRRYEKSDMPSTAESEIRKLFRL

SEQ ID NO: 4525 - protein, 258 aa, Burkholderia cepacia
MSVLSFLNDTASKAVLSPRELSSISTSISTLKSRLATHFEGEVIKKHFCFGSSTRGTILPRSMDRKSDIDYMVVFGDGGFLPQTYLNRLKIFVEDNYRTSEIFQSSPTIVLELNHIKFDLVPATLSWLGGLRIPHGPGHWQSTYPNDFNRTLETRNKDHCSLIKPTIRLFKYWNATSGYPFPSFSMEKWVCQQGFWWRTGLKDYFFSVIDSLSTSSSQPKWVNDEIKRAKKIVANTKYYELGTMGQEAETEIRRLFRL

SEQ ID NO: 4526 - protein, 258 aa, Burkholderia cepacia
MSVLSFLNDTASKAVLSPRELSSISTSISTLKSRLATHFEGEVIKKHFCFGSSTRGTILPRSMDRKSDIDYMVVFGDSGFLPQTYLNRLKIFVEDNYRTSEIFQSSPTIVLELNHIKFDLVPATLSWLGGLRIPHGPGHWQSTYPNDFNRTLETRNKDHCSLIKPTIRLFKYWNATSGYPFPSFSMEKWVCQQGFWWRTGLKDYFFSVIDSLSTSSSQPKWVNDEIKRAKKIVANTKYYELGTMGQEAETEIRRLFRL

SEQ ID NO: 4527 - protein, 258 aa, Burkholderia cenocepacia
MSVLSFLNDTASKAVLSPRELSSISTSISTLKSRLATHFEGEVIKKHFCFGSSTRGTILPRSMDGKSDIDYMVVFGDGGFLPQTYLNRLKIFVEENYRTSEIFQSSPTIVLELNHIKFDLVPATLSWLGGLRIPHGPGHWQSTYPNDFNRTLETRNKDHCSLIKPTIRLFKYWNATSGYPFPSFSMEKWVCQQGFWWRTGLKDYFFSVIDSLSTSSSQPKWVNDEIKRAKKIVANTKYYELGTMGQEAETEIRRLFRL

SEQ ID NO: 4528 - protein, 258 aa, Burkholderia pseudomallei
MSVLSFLTSTASNAILAPVEQASIDVSIGSLQSRMAQHFAPGMIKQHFRFGSSTRGTILPRALDEQSDIDYMIVFNDGNATPQTYLSRLRTFVEKRYRSSEIYQSNPTIVLELNHIKFDLVPATTAWLSGLRIPSGPDRWMSTDPKDFNGVLEAKNKANKSLIKPTIRLFKYWNAASGYPFESYAMEKWVCGLNFWGQSNQKDYFFAVVNSLSTSWSQPQRVNDEISRAKKIIANVRQFERSDMQVKGETEIRRLFRL

SEQ ID NO: 4529 - protein, 258 aa, Burkholderia vietnamiensis
MSVLSFLTSTASNAILAPIEQASIDVSIASLQSRMAQHFAPGMIKQHFRFGSSTRGTILPRALDEQSDIDYMIVFNDGNATPQTYLSRLRTFVEKRYRSSEIYQSNPTIVLELNHIKFDLVPATTAWLSGLRIPSGPDRWMSTDPKDFNGVLEAKNKANKSLIKPTIRLFKYWNAASGYPFESYAMEKWVCGLNFWVQSNQKDYFFAVVDSLSTSWSQPQRVNDEISRAKKIVANVRQFEKSDMQVKAETEIRRLFRL

SEQ ID NO: 4530 - protein, 257 aa, Alphaproteobacteria bacterium
MTVNSYLVKRASDAVLSSNEQSSIETSISTLRTRLNSYFAKDVSNHFKFGSSTRGTILPRRMDPQSDIDYMVVFNDDRYTPQTYLNKLSAFARNWYFSSEIKQSTPSIVLELDHIKFDLVPALKDTYGSGYQIPNGPNAWQSTDPNDFNAALIQKNTDNRSLIKTTVRLLKFWNASKGYVFESFSLEKWLISQHYYPQDNQRDYFLQSIEKLGINTTTQWRKDALERAKQIVDNVRQYERSGMLATAEAEVKKLIPE

SEQ ID NO: 4531 - protein, 257 aa, Alphaproteobacteria bacterium
MTVNSYLVKRASDAVLSSNEQSSIETSISTLRARLNSYFGEDVSNHFKFGSSTRGTILPRSMDTQSDIDYMVVFKDGGYTPQTYLNKLKKFAEYYYQTSEIKQSSPSIMLELNHIKFDLVPALKDAYGSGYQIPNGPNAWQSTDPNDFNAALTQKNSDNKSLIKTTVRLLKFWNASKGYIFESFSLEKWVIGQFYYPQDNQRDYFLQSIEKLPVPTEVQWHKSAVERAKEIVANVRQYERDDMPATAEGEVKKLIPE

SEQ ID NO: 4532 - protein, 257 aa, Bosea sp.
MSVLGYLQKRASDAVLSGDEKNSITTSISTLKTRLGYHFPTGLKEHFRFGSSTRDTILPRPMDEHSDIDYMIVFSESGYTPQTYLDRVRRFVETYYSTSEIKQSSPTIVLQLNHIKFDLVPALPEVWSGYQIPNGSGGWQSTNPNDFNKSLEAANKANLYLLKPTIRLAKFWNAKAGYVFDSFSFEKWMMNQSYCAVYNQRDYLFTVFDTLTTSGVNEQWRRDKIERAKQIVAQVRKLEKDEMPFTAEAEVKKLIPE

SEQ ID NO: 4533 - protein, 257 aa, Sphingobium yanoikuyae
MSVLTYLQTRASQAVLSGAENTSINTSISTLATRLNSYFGANVSRHFRFGSSTRGTILPRAMDEHSDIDYMIVFSEGGYTPQTYIDRLRKFAEYYYPTSAIKQSSPTIVLQLNHIKFDLVPALAGYWAGEYKIPNGTSAWRDTNPNDFNATLTAKNQAELSLIKPTIRLAKFWNARNGYVYDSYGFEKWIVAQSYTFALNQKSYLFNVFDNLLANDATQWRNDRISRAKEIVAKVRELEAAEMPYSAEAEIKKLIPE

SEQ ID NO: 4534 - protein, 256 aa, Erythrobacteraceae bacterium
MSVLNYLQGRASQAVLSGDEQSSINTSISTLSTRLNAYFGDKLTEHFRFGSSTRSTILPRSMDEHSDIDYMVVFAKGGYTPQTYLDQLRRFVETYYSSSDIKQSSPTIVLQLNHIKFDLVPALKGVWSGYQIPNVSGGWQNTNPNDFNATLTAKNQAELNLIKPTIRLAKFWNAKNGYVFDSYSFEKWIVEKNYFLAINQKDYLFAVFDKLSANESAQWRNDRINRAKQIVAKVRDYERDNMPITAESEVKKLIPG

SEQ ID NO: 4535 - protein, 258 aa, Roseomonas gilardii
MSVLSYLQTRASNAVLSSDERNSIAISTSSLQNRLIRHFPGELAEQFRFGSFTRDTILPRKMDERSDIDYMIVFKEGGYTPQTYLDRLRRFVSTYYQRSEIYQSSPTIVLELNHIKFDLVPALKRAWGSGYQIPNGSGGWQDTEPNDFNQVLEDTNKSNSYLIKPTIRLAKFWNSDARYIFDSFLFEKWIMALSYWSVSNQRDYLFTVFDNLSTHSVSEQWRKDQIERAKKIVAKVRELERDGMPYMAEAEVKKLIPE

SEQ ID NO: 4536 - protein, 259 aa, Rhizobium leguminosarum
MSVNSYLASRASSAVLSEDERKSINTSIAALGTRLDSWFQVDGDKLQSHFRFGSQTRGTILPRRDDQHSDVDYMVVFENGGRKPQSYLDRLKKFVEGKYSTSEVYQSSPTIVLELNHIKFELVPAQHYYGSTYQIPNGPNDWQSTSPNDFNATLEEKNKANGYLIKPTIRLAKIWNAANGYVFNTYLFEKWICDRSFWLASNQRDYLFTVFDNLQATESAAWRNERITRAKKLVAEIRENESQGYPYLAEADAKKLIPG

SEQ ID NO: 4537 - protein, 259 aa, Mesorhizobium sp.
MTVNSYLVSRASDAVLSADEKASIATSVTTLSSRLASYFTVAGDGLTSHFRFGSHTRGTILPRKMDAHSDVDYMIVFEKGGLNPQTYLTRLRKFAEQKYANSELYQSSPTVVLELNHIKFDLVPALFSWGTTYQIPKGPDEWQSTNPNDFNSTLETVNGNNSYLIKPTVRLVKFWNAEAGYVYDSYGLEKWIVGLGFYGCYTQKDYFFKVFENLSANEVAQWRNDKITRAKDIIARVRKYEADDMPNSAEIEVKKLVPA

SEQ ID NO: 4538 - protein, 259 aa, Mesorhizobium sp.
MTVNSYLVSRASDAVLSADEKASIATSVTTLSSRLASYFTVAGDGLTSHFRFGSHTRGTILPRKMDAHSDVDYMIVFEKGGLNPQTYLTRLRKFAEQKYANSELYQSSPTVVLELNHIKFDLVPALLSWGTTYQIPKGPDEWQSTNPNDFNSTLETVNGNNSYLIKPTVRLVKFWNAEAGYVYDSYGLEKWIVGLGFYGCYTQKDYFFKVFDNLSANEVAQWRNDKITRAKDIIARVRKYEADDMPNSAEIEVKKLIPA

SEQ ID NO: 4539 - protein, 258 aa, Bordetella avium
MSVISYLDARASSAVLSTDEQASINASIVTIKSRLNNYFGTALSEQLRFGSSTRGTILPRKMDQHSDIDYMVVFAQGGAVPQTYLDRLKRFAEQYYSTSDIKQSSPSLVLQLNHIKFDLVPALKVWGTTYQIPNGPAAWQNTNPNDFNGQLDALNHKEMYKIKPMIRLLKYWNAEAGYIFDAYSLEKFVVSLSYYGVINIRDYLFTAFDNLYLGSDQAQWRKDKVKRAKDIIAEVRSLERDGYPNLAEAEVKKLIPSA

SEQ ID NO: 4540 - protein, 258 aa, Limnohabitans sp.
MSVISYLDVRSSSAVLSVDEQASINTSIATIKTRLNSYFGVALSEHLRFGSSTRGTILPRKMDQHSDIDYMVVFAEGGAVPQTYLDRLRRFADQHYATSDIKQSSPSLVLQLNHIKFDLVPAIKAWGTTYQIPDGPSAWQNTNPNDFNGQLNTINQKEMYKIKPMIRLLKYWNAEAEYVFDAYSLEKFVISLSYYGVSNIRDYLFTAFDNIYLGSDQAQWRKDKLKRAKEIIDEVRSLESNGYPSLAEKEVKKLIPSD

SEQ ID NO: 4541 - protein, 256 aa, Novosphingobium sp.
MTVNSYLTNRASNAILSTGEQDSINRSVATLQTRLNSYFGSKLNSHFRFGSSTRGTILPRSMDGHSDIDYMVVFAEGGYTPQTYLNRLRAFVDAYYSSSDIKQSSPTIVLELNHIKFDLVPALANMWGGYQIPDGTSAWQNTNPNDFNGKLTEKNTANHHLIKPTIRLVKFWNAQNGYVFDSYSLEKWIVDQSYFYISTQRDYLLETFEKLATPTDTQWRKDKVERAKKIVAEVRRLERENMPVSAELEIKKLIPE

SEQ ID NO: 4542 - protein, 256 aa, Blastomonas sp.
MTVNSYLTNRASNAILSTGEQDSINRSVATLQTRLNSYFSSKLNSHFRFGSSTRGTILPRSMDGHSDIDYMVVFAEGGYTPQTYLNRLRAFVDAYYSSSDIKQSSPTIVLELNHIKFDLVPALANMWGGYQIPDGTSAWQNTNPNDFNGKLTEKNTANHHLIKPTIRLVKFWNAQNGYVFDSYSLEKWIVDQSYFYISTQRDYLLETFEKLATPTDTQWRKDKVERAKKIVAEVRRLERENMPVSAELEIKKLIPE

SEQ ID NO: 4543 - protein, 256 aa, Nitrosospira briensis
MSVITYLEKRASNAVLSEIEKISINRSIDTIKSRLDSYFGTELKEHFRFGSSTRGTILPRSMDGKSDIDYMIVFKDDGYTPQTYLDRIKRFADIYYSSSEIKQSSPSIVLQLNHIRFDLVPALSNWYQGYRIPNGGSAWRDTNPNDFNAQLTVKNNAELSMIKPTIRLVKFWNAQGGFIYDSYGLEKYIVELGFFNCGNQKDYLFKVIDSLNSYTEVQWKKEEIERAKKIIAQVRAYESGGMPYSAENEVKKLIPD

SEQ ID NO: 4544 - protein, 255 aa, Nitrosospira sp.
MSVITYLEKRASNAILSGAEEISINRSIDTIKNRLDSYFGPELSAHFRFGSSTRGTILPRSMDRQSDIDYMVVFNKGGYAPQTYLDRIKKFADFYYSSSEIKQSSPSIVLQLDHIRFDLVPALSNWPFGYRIPNGASAWRDTNPNDFNETLIAKNNVESFLIKPTIRLAKFWNMQRGAIFDSFLLEKHIVGIWFFLCNNQKDYLFKAIDSLDSYHNAQGKREEIERAKYIVAKVRQYERDGMPNSAEAEVKKLIP

SEQ ID NO: 4545 - protein, 292 aa, Unknown
  Description of Unknown: uncultured bacterium sequence
MTVSSYLKQIVDNAIIRDDEKESIDRSIEYLQKCLQSHFGTEVNSHFRFGSHTRGTILPRSMDVNSDIDYMVVFADNSYKPQTYLNKLKQFVEKYYQASQIHQSNPTIVLELNHIKFELVPAIIQHGLFYQQLYIPAKVSDLNDWIATDPNAFNNSLTEKNKEHNFLIKPVIRLVKYWNAINNYPFESYDLERWIVNYDFYACDWLFHIPESKKYFLNFMDDLNLSYFAPDWKKHKLETAKTIIQKVRYYEAQAITIMAETEIRKLIPDPNQRLYGRRALLGEKLSQIRPLL

SEQ ID NO: 4546 - protein, 265 aa, Pseudodesulfovibrio indicus
MSSLNYLRFMSRVAVLPEAEKEKIQRSIGFIKLKLKKYFGNEIKAQFQFGSSTRGTILPRRLDERSDIDYMIVFSNGGYRPQTYLDRLRRFVADTYKASRVHQSHPTIVLNMNHIKFELVPAVEHFWSGYDIPAKATDYEDWIGTDPNDFNDDLTSRNQMYSNLTKPTIRLLKYWNAQNGYPFESFELEKQVVDMFFFWNSPRNVKEYVYSAFGELDLGLSSSVRSRYALERAQNHIREAKAYDGLGNDMLALKEIKKVIPPING

SEQ ID NO: 4547 - protein, 272 aa, Pseudoxanthomonas suwonensis
MTINSYLTNLANQAILRDDEKAGVQRSIATLQTRLEDHFGAQMSQHFVFGSYSRGTILPRSMDPQSDVDYMVVFSDGGLQPQSYLDRLRRFAELRYARSEVAQSHPTVALELNHIRFELVPALQNWWGGLQIPAKGSGYQSWQGTDPKGFNNMLTSANQANGNLIKPLARIMKYWNAKAGYPFESYALEQQVAGHGYGFFGLLASRQVGDYFFEIVDALDAGLFAPQWKRDAVTRLKDLTTQARALERAGQTAQADAVIAKLVPPVGGLLGR

SEQ ID NO: 4548 - protein, 274 aa, Halioglobus pacificus
MTVNSYLTNLAGTAIIRDAEKDSIGRSIAILDGRVRQHFGRETNQQLIFGSYSRGTILPRSMDEKSDVDYMVVFTDSAATSQTYLNRLRRFVEVYYSRSEISQSHPTIVLSLNHIRFELVPAINIWLSGLQIPAKASAFESWIDTDPTGFNQELSNANQAHRNLIKPLVRVMKYWNASNGYPFESYALEQDIVRHGFGFFGLLSGRQLKDYFYDFMEELDAGWLAPQWKKDAVTRSQRLAAEAKNQEQQGYPASAEGTIRKLLPPTSQLALGGV

SEQ ID NO: 4549 - protein, 271 aa, Legionella drozanskii
MTINSYLTQLANEAILKDSEKLSIERSLIAIQTRLSTYFSGDIKKQFVFGSYSRGTILPRVMDILSDVDYMIVFSDTQYQPQTYLNKLRSFAEYHYSRSEITQSNPTMVLTMNHIRFELVPAIESYLGGLQIPGKVNNYQNWMQTDPTGFNQVLSSTNQSNQSLIKPLIRLVKYWNARNNYPFESFDLEQRIVQHKFSLIGLFGNPQLKNYFFSFMEGLEVCYLAPQWKQDTLNKAKKIIKEAKELDRDGYPATAEETIAQFLPRISGYTS

SEQ ID NO: 4550 - protein, 271 aa, Legionella santicrucis
MTINSYLTQLANEAILKDSEKLSIERSLIAIQTRLSTYFSGDIKKQFVFGSYSRGTILPRAMDLLSDVDYMIVFSDTQYQPQTYLNKLRSFAEYHYSRSEITQSNPTMVLTMNHIRFELVPAIESYLGGLQIPGKANNYQNWMQTDPTGFNQVLYSTNQSNQSLIKPLIRLVKYWNARNNYPFESFDLEQRIVQHKFSLIGLFGNPQLKNYFFSFMEGLEVGYLASQWKQDALNKAKKIIKEAKELDRDGYPATAEETIAQFLPRISGYTS

SEQ ID NO: 4551 - protein, 270 aa, Alcanivorax sp.
MTVNSYLQVLSSSAVIRDQEKESIQKSIATLQQRLDQHFGNDITDHFIFGSYTRGTILPRSMDEHSDIDYMVVFGETSSSPQTYLNRLRRFVSIYYSRSQISQSAPTIVLSLNHIKFELVPAIDSWWSGLRIPAKRSELDDWIQTNPNDFNETLISTNKSNNNLIKPMIRLVKYWNARNGYLFESFTLERHLAEKSYFWIGGIWEPGQLKDYFFDAIGSLGYNGRDPKYKIDAIKRAHELSDQAQRLISRGQEGQAESVIYRLLPAPISA

SEQ ID NO: 4552 - protein, 256 aa, Rhizobium sp.
MTAQSYLYNRATNAVLSDDEKSSIVKSIATLKSRLNAYFDGNLLQHFAFGSYTRNTILPRALDAESDVDYMAVFAEGGYTPQTYLDRLKRFTEYRYNRSEIYQSSPTLVLNLNHIRFELVPALDHASGYSIPDGSGGWILTTPNTFNTALTEKNKATNSRLKPAIRLAKIWNADRGYPFASYPMERQAAGISYSGCADTVMSHFFRLMDNLVLPSGSVRISMNRDSDFSKSRTSISLSRGQRARSSSASLVAVMGD

SEQ ID NO: 4553 - protein, 258 aa, Escherichia coli
MTVSTYLESIKNKAYQKDITITNSINTIKRRLDYFFSSEIKEHFVFGSYSRNTMLPRSYDRFSDVDYMIVFKNVIHQPQTYLNKLKKFVNFYYSTSEIKQSHPTIQLNLNHITFELVPASHSIFYGYQIPSKDDLLGRWMQTDPLDFNMQLTNCNKNNKSLIKPLIRIMKYWNANSGYVFESYQLEKKIVSFNYFWCSTLKEYFYSAVEQLSAPYEFAYWKKLKIQKLKDSVKLAKYYETIDCPLSAEKEIKSILPEI

SEQ ID NO: 4554 - protein, 258 aa, Escherichia coli
MTVSTHLESIKNKAYQKDITITNSINTIKRRLDYFFSSEIKEHFVFGSYSRNTMLPRSYDRFSDVDYMIVFKNVIHQPQTYLNKLKKFVNFYYSTSEIKQSHPTIQLNLNHITFELVPASHSIFYGYQIPSKDDLLGRWMQTDPLDFNMQLTNCNKNNKSLIKPLIRIMKYWNANSGYVFESYQLEKKIVSFNYFWCSTLKEYFYSAVEQLSAPYEFAYWKKLKIQKLKDSVKLAKYYETIDCPLSAEKEIKSILPEI

SEQ ID NO: 4555 - protein, 258 aa, Unknown
  Description of Unknown: Enterobacteriaceae sequence
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4556 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRGFVNYYYRTSEIKQSHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQWKKDKIQRLKNSVMMSKYYEQLNNHFAAENEIKKILPIK

SEQ ID NO: 4557 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHIAFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4558 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQIHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4559 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHITFELVPASHNILFGYQIPSNQDFLNRCMNTDPNAFNTDLTNCNKNNNNLIKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4560 - protein, 258 aa, Escherichia coli
MTVSTYLESIKSNAYQRDITITNSIATIKNRLNGYFAGELVSHFVFGSYSRSTMLPRSYDPSSDVDYMVVFKNVIYQPQTYLNKLRDFVNYYYRTSEIKQSHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4561 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHITFELVPASHNILFGYQIPSNQDFLNRWMNTDPNAFNTDLTNCNKNNNNLSKPLIRIMKYWNANAGYVFESYQLEKDIVSFNYFWCSTLKEYFYSAVEQLSGSYYLAQWKKDKIQHLKNSVMMSKYYEQLNNHFAAENEIKKILPIK

SEQ ID NO: 4562 - protein, 258 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSSSYYLAQWKKDKIQHLKNSVMMSKYYEQLNNHFAAENEIKKILPIK

SEQ ID NO: 4563 - protein, 219 aa, Escherichia coli
MTVSTYLESIKSNAYQRDITITNSIATIKNRLNGYFAGELVSHFVFGSYSRNTMLPRSYDPSSDVDYMVVFKNVIYQPQTYLNKLRDFVNYYYRTSEIKQSHPTIQLNLNHITFELVPASHNILFGYQIPSNQDFLNRWMNTDPNAFNTDLTNCNKNNNNLIKPLIRIMKYWNANAGYVFESYQLEKDIVSFNYFWCSTLKEYFYSAVEQLSGSYYLAQ

SEQ ID NO: 4564 - protein, 259 aa, Serratia sp.
MSVQSYLDSIARNAILKDSSVTTSIATLKARLNLYFNATDVTNHFTFGSNTRYTMLPRKYDPQSDVDYMIVFNNTGYQPQTYLNKLKNFVEYYYTSSEIKQSHPTIRLNLNHITFELVPAIYNIFYGYQIPAPADNFQSWINTDPNAFNLSLTEKNKNNYHLIKPLIRILKYWNANAGYVFESYELEKNIVSMNFFFCHNIKDYFYSAVESIYCSYLAPQWKQNAVNKLKNVVAETKLNEANGWNFLAEAEIKKILPEI

SEQ ID NO: 4565 - protein, 259 aa, Unknown
  Description of Unknown: Enterobacteriaceae sequence
MSVQSYLDTISKNAILKDSTITTSISTLQRRLGYYFDNNVVISHFAFGSNTRYTMLPRKYDPQSDVDYMVVFSNTGHQPQTYLNRLKNFVECYYSSSERKQSHPTIKLNLHHITFELVPAVYNTIYGYQIPAPANNFETWISTNPNDFNSKLTDKNRNNYSLIKPLIRILKYWNANAGYVFESYELEQNIVSMNFLFCYNIKDYFYHAVGQLNCSYWSPQWKQNAVNKLKNTVNSVKAYESGGWHYSAETEIKKILPEV

SEQ ID NO: 4566 - protein, 259 aa, Pluralibacter gergoviae
MSVQSYLDTISKNAILKDSTITTSISTLQRRLGYYFDNNVVINHFAFGSNTRYTMLPRKYDPQSDVDYMVLFSNTGHQPQTYLNRLKNFVECYYSSSERKQSHPTIKLNLHHITFELVPAVYNTIYGYQIPAPANNFETWISTNPNDFNSKLTDKNRNNYSLIKPLIRILKYWNANAGYVFESYELEQNIVSMNFLFCYNIKDYFYHAVGQLNCSYWSPQWKQNAVNKLKNTVTSVKAYESGGWHYSAETEIKKILPEV

SEQ ID NO: 4567 - protein, 259 aa, Klebsiella pneumoniae
MSVQSYLDTISKNAILKDSTITTSISTLQRRLGYYFDNSVVISHFAFGSNTRYTMLPRKYDPQSDVDYMVVFNNTGHQPQTYLNRLKNFVECYYSSSERKQSHPTIKLNLHHITFELVPAVYNTIYGYQIPAPANNFETWISTNPNDFNSKLTDKNRSNYSLIKPLIRILKYWNANAGYVFESYELEQNIVNMNFLFCYNIKDYFYHAVGQLNCSYWSPQWKQNAITKLKNTVMSVKAYESGGMPYSAEAEIKKVLPDI

SEQ ID NO: 4568 - protein, 259 aa, Escherichia coli
MSVQTYLDTISRNAILKDSTITTSISTLQRRLGYYFDNSVVIRHFAFGSNTRYTMLPRKYDPQSDVDYMVVFSNTGHQPQTYLNRLKNFVECYYSSSERKQSHPTIKLNLHHITFELVPAVYNTMYGYQIPAPANNFETWISTNPNDFNSKLTDKNRSNYSLIKPLIRILKYWNANAGYVFESYELEQNIVSMNFLFCYNIKDYFYHAVGQLNCSYWFPQWKQNAITKLKNTVIAVKAYESGGMPYSAEAEIKKVLPDI

SEQ ID NO: 4569 - protein, 259 aa, Yersinia enterocolitica
MSVQSYLDSVAKNAILKDSTITTSISTLKNRLGYYFDSSEVTNHFTFGSNTRYTMLPRRYDPKSDVDYMVVFNNTGHQPQTYLNRLKYFVERYYSSSERKQSHPTIRLNLSHITFELVPAVYNVFYGYQIPAPANNFETWISTDPNDFNSKLTDKNRNNYSLIKPLIRILKYWNANADCVFESYDLEQKIVSMNFLFCYNIKDYFYYAVEQLHCSYWSPQWKQNALNKLKNTVSSAKAYESGGWYYSAELEIKKILPEI

SEQ ID NO: 4570 - protein, 259 aa, Klebsiella pneumoniae
MSVQSYLDSVAKNAILKDSTITTSISTLKNRLGYYFDSSDVINHFTFGSNTRYTMLPRRYDPKSDVDYMIVFNNTGHQPQTYLNRLKYFVERYYSSSERKQSHPTIRLNLNHITFELVPAVYNVFYGYQIPAPANNFETWISTDPNDFNSKLTDKNRNNYSLIKPLIRILKYWNANADYVFESYDLEQKIVGMNFLFCYNIKDYFYSAVEQLHCSYWSPQWKQNAVNKLKNTVSSAKAYESGGWHYSAESEIKKILPEI

SEQ ID NO: 4571 - protein, 259 aa, Raoultella ornithinolytica
MSVQSYLDSVAKNAILKDSTITTSISTLKNRLGYYFDSSDVINHFTFGSNTRYTMLPRRYDPKSDVDYMVVFNNTGHQPQTYLNRLKYFVERYYSSSERKQSHPTIRLNLNHITFELVPAVYNVFYGYQIPAPANNFETWISTDPNDFNSKLTDKNRNNYSLIKPLIRILKYWNANADYVFESYDLEQKIVGMNFLFCYNIKDYFYSAVEQLHCSYWSPQWKQNAVNKLKNTVSSAKAYESGGWHYSAESEIKKILPEI

SEQ ID NO: 4572 - protein, 259 aa, Klebsiella sp.
MSVQSYLDSIAKNAILKDSTITTSISTLKNRLGYYFDSSDVINHFTFGSNTRYTMLPRKYDPQSDVDYMVVFNNTGYQPQTYLNRLKYFVERYYSASERKQSHPTIRLNLNHITFELVPAVYNVFYGYQIPAPANNFETWISTDPNDFNSKLTDKNRSNYSLIKPLIRILKYWNANADYVFESYDLEQKIVGINFLFCYNIKDYFYYAVEQLHCSYWSPQWKQNAVNKLKNTVSSAKAYESGGWPYSAESEIKNILPEI

SEQ ID NO: 4573 - protein, 270 aa, Firmicutes bacterium
MSVQSYLISLASKLVLKEEEKENITRSLKTLQERVSSYYGREVINHFPFGSYTRGTILPRKADSNSDIDYMIIFNNPNQYKPQTFLNYLKQFVNYYYHRSEIYRDYPTVVLELNHIKFELVPATLGSVFSQGYQIPAPAKSYSEWMLTYPNQFNAELTEKNKNNHSLIKPLVRLMKYWNAQNGYIFSSYELERWIVQQYYLFDQNIKDYFCTAITNLPYSMDGFEVFASPQSHKQKIDRAKQIMKNVINFENAGLVDYAVTEIKKILPEF

SEQ ID NO: 4574 - protein, 263 aa, Firmicutes bacterium
MSVLSYLEDTASSLVLSSNEKSSITTSVSTIKSRIDSYFGSDVKDHFQFGSYTRDTILPRKYDERSDVDYIVIFKNPDNYKPQTLLNWLKQFAEKYYSSSEIYQSHPTMVLELSHIKFELVPAIKDGWGTISIPSPSSTYSDWMTTDPNGFNTSLTNANTNNSYKIKPLIRLMKYWNVKKVSRGYSSFLLEKWVVDNSYYSCSNLKDYFFKCIDDISYNYDSPQYLKTAIDNAKTVVKNIRQYEKDGQITSAENEIKKIIPEL

SEQ ID NO: 4575 - protein, 261 aa, Unknown
  Description of Unknown: Bacillus cereus group sequence
MSVQSYLENLSSNLVLSDLEKSDIVTSISTLSTRLNIYFGTDLKKHFQFGSYTRGTILPRKVDSNSDIDYMVIFHNPYNYKPQTLLKYLRTFVNKYYGRSEIYQDSPTIVLELKHIKFELVPAMEQWGTIYIPAPATEYTDWMQTDPTGFNEKLTRANTISHSRVKPLVRLMKYWNRLNGNYYSSFLLENWIVNNNTYYKGSLKEYVFSFFDNLTYDYSAPQYLKTNIDKAKRIINNVRYYERIGQAYNAEMEIRKLLPGV

SEQ ID NO: 4576 - protein, 265 aa, Bacillus tequilensis
MSVNTYLTTLSSNLVLSSIENESIKKSINTLSKYLNWYFDSNDLHEHFRFGSSTRGTILPRSADSGSDVDYMVVFKNPNGYKPQTLLKYLKEFMEKYYSRSEIYQSSPTMVLELNHIKFELVPAVKDDWGNLSIPAPATDFLEWTSTDPGGFNSDLSTANVHNNYQLKPLIRLMKYWNTNKLKGYYSSYLLEKWLVNRYSFFTKSSLKEYVYDSIEGLNYNYNDSQTFKDRLDSAKKAVSNCKAYELSAYPGLAETEIKKLFPEL

SEQ ID NO: 4577 - protein, 265 aa, Bacillus subtilis
MSVNTYLSTLSSNLVLSSIENESIKKSINTLSKYLNWYFDSDDLHEHFRFGSSTRGTILPRSADSGSDVDYMVVFKNPNGYKPQTLLKYLKEFMEKYYSRSEIYRDSPTMVLELNHIKFELVPAVKDDWGNLSIPAPATDFLEWTSTDPGGFNSKLTTANVHNNYQLKPLIRLMKYWNTNKLKGYYSSYLLEEWLVNRYSFFTKSSLKDYVYDSIEGLYYNFNDSQTFKDRLDYAKKVVSNCKSYELTAYPGLAETEIKKLFPEL

SEQ ID NO: 4578 - protein, 265 aa, Bacillus sp.
MSVNTYLTTLSSNLVLTSTENENIKKSINALSKNLNYYFDSNDLHEHFQFGSSTRGTILPRSADSGSDVDYMVVFKNPDGYKPQTLLKYLKAFMEKYYSRSEIYRDSPTMVLELNHIKFELVPAIKDDWGNLSIPAPTNILFEWTSTDPVGFNSELITANVNNNYQLKPLIRLMKYWNTDKLKGYYSSYLLEKWLVNRYNYFTKSSLKEYVYDSIEGLYYNYDASQTFKNRLDYAKKVVSNCKSYELTGYPGLAETEIKKLFPEL

SEQ ID NO: 4579 - protein, 265 aa, Unknown
  Description of Unknown: Sporosarcina sequence
MSVNNYLTTLSSELVLSSTENTNIKTSITTLAQRLNWYFNNGELHNHFQFGSNTRGTILPRSVDSKSDVDYMVVFKNPNGYKPETLLKYLKDFMYKYYSTSEIYKDSPTMVLELNHIKFELVPAIQDDWGNLSIPSKTNLLSDWMSTDPTGFNQKLTNANVTNNSKLKSFIRLMKYWNTNKLGHHYSSFLLENWIVNRYNYFPKSSLKEYLYDSIEGITYNWDDSQTFKDKLDRAKLIVSNCKSYEANGYNALALKEIKKLLPEI

SEQ ID NO: 4580 - protein, 265 aa, Thalassobacillus devorans
MSVNGYLTTLSSNLVLSSSENSSIRTSISTLSSRLNSYFNNGQLHKHFQFGSSTRGTILPRKADSNSDIDYMVVFKNPNNYKPETLLNYLRNFMKAKYSRSEIYKDSPTMVLELNHIKFELVPAIQDYWGNLSIPSRTNFLSDWMSTDPTGFNESLINANRNNNSKIKPAIRLMKYWNTNKLNYYYSSFLLEKWVVNKFHYSSRPYIKDYVFDSIESLSYNYNDSQSFKGKLDRAKQIVHNTRIYEHQGKPISAENEIKKLFPEF

SEQ ID NO: 4581 - protein, 265 aa, Bacillus toyonensis
MSVNNYLTMLSSNLVLSPVENVNITTSISTLSRRLNLYFNNGELHNHFQFGSSTRGTILPRRVDSNSDVDYMVVFKNPKGYTPETLLKYLKDFMYCYYQRSEIYRDSPTMVLELNHIKFELVPAIQDEHGNFLIPSKTNFLSRWMPTDPLGFNAKLTRVNVYNSSKIKPLVRLMKYLNRNKLNGYLSSYELENLLVQKFDYNSKSSLKEYLYTSIESLTPSYDDSHTYKEQLERVKNKIRDVQWYEANGYPDTAERKIKELFPHI

SEQ ID NO: 4582 - protein, 262 aa, Bacillus cereus
MSVQSHLESLASKLNLKQDEKDKVKKSIDTLSDRLDRYFNGELKEHFQFGSYTRGTILPRKADEYSDVDYMIIFINPNDYKPQTLLNYLKKFAEYYYHSSEIYRSHPTIVLELNHIKFELVPSKKDYWGNIYIPSPSSSYEEWMKTDPNDFNKKLTDANVKYSYEIKPLVRLMKYWNRLNGSYLSSYELENWITENYYWNCSNLKDFIYSTFEKLNYNYSSPQYYKDKVDRAKKIIAKTKEYEADGMPYSAQEEIKKLFPDF

SEQ ID NO: 4583 - protein, 262 aa, Bacillus cereus
MSVQSHLESLASKLNLKQDEKDKVKKSIDTLSDRLDRYFNGELKEHFQFGSYTRGTILPRKADEYSDIDYMIIFINPNDYKPQTLLNYLKKFAEYYYHSSEIYRSHPTIVLELNHIKFELVPSKKDYWGNIYIPSPSSSYEEWMKTDPNDFNKKLTDANVKYSYEIKPLVRLMKYWNRLNGSYLSSYELENWITENYYLNCSNLKDFIYSTFEKLNYNYSSPQYYKDKVDRAKKIIAKTKEYEADGMPYSAQEEIKKLFPDF

SEQ ID NO: 4584 - protein, 262 aa, Bacillus thuringiensis
MSVQSHLESLASKLNLKQDEKDKVKKSIDTLSDRLDSYFNGDLKEHFKFGSYTRGTILPRKADEYSDVDYMVIFINPHDYKPQTLLNYLKKFAEYHYHSSEIYRSHPTIVLELNHIKFELVPSKKDYWGDIYIPSPSSSYEEWMKTDPNDFNKKLTDANVKYSYEIKPLVRLMKYWNRLNGSYLSSYELEDWITENYYWNCSNLKDFIYSTFEKLNYNYSSPQYYKDKVDRAKKIIEQTKEYEADGRPYSAQEEIKKLFPDF

SEQ ID NO: 4585 - protein, 263 aa, Lysinibacillus fusiformis
MTVQTYLDGLASKLYLKQDEKDKINKSIDTLASRLNLYFNNNQLNDHFKFGSYTRGTILPRKADAYSDVDYMVIFKNPYNYKPQTLLNYLKDFVNVYYKSSEIYQSHPTIVLELNHIKFELVPAKVDSWGNIYIPSKSSLFEEWIMTDPNAFNKKLSDKNGSNNYEIKPLVRLMKYWNRLNGSYSSSYALENRIVDNYYWGCSNIKDYVYSSIEKLEYNYYDPQDYKYNVDRAKKIVADTKEYERQNLPISAEIEIKKLFPDF

SEQ ID NO: 4586 - protein, 262 aa, Fictibacillus phosphorivorans
MTVQSHLDGLASKLNLKQEEKDKVNKSIDTLSTRLKAYFDDELNGHFKFGSYTRGTILPRKADIYSDVDYMVIFKNPNNYKPQTLLNYLKDFVNHYYKSSEIYQSHPTIVLELNHIKFELVPAKKDTWGDLYIPSKSSPFEEWMKTDPNAFNKKLSDKNGSHNYEIKPLVRLMKYWNRLNGSYRSSYLLENSIVENFYWNCSNIKEYVYSTIEKMDYSYFDPQGYKDKVDRAKKIVANTREYESENMPYSAETEIKKLFPDF

SEQ ID NO: 4587 - protein, 262 aa, Planococcus maritimus
MSVQSHLSSLSSALNLQQEEKDKVSKSVDTLSSRLNTYFSRDLDGHFKFGSYTRRTVLPRKADENSDVDYMVVFKNPYEYKPQTLLNHLKAFVNKYYYSSEIYQSHPTIVLELNHIKFELVPAKKDFLGNLYIPSPSSSYTEWMITQPNTFNSKLSDANATYHNQIKPLVRLLKYWNRLNGSHRTPYLLEKWVVDNYYWNCINIKEFVYSTFEKLDYDYTDSQNYKDKVNRAKRIIAKTKELERDNLPISAENEIKKLFPNF

SEQ ID NO: 4588 - protein, 262 aa, Domibacillus antri
MTVQSHLDNLASRLNLKEVEKEKISTSIETLSSRLNYYFGSQLTDHFKFGSYTRGTILPRKADEYSDVDYMLIFENPYGYKPQTLMNYIRKFVNHYYRASEISQSHPTIVLELNHIRFELVPAKKDLWGTIYIPSRKSFYEEWISTEPNAFNQKLTTANTQHNSKIKPLVRLMKYWNRINGGHLSSYELENWIAGNSYWGNTTLKDYVYNTFEKLTPAYSDPQSYKSKLERAKKIIESTKEYERSGMPYSAESEIQKLFPDF

SEQ ID NO: 4589 - protein, 263 aa, Bacillus cereus
MSIQTYLNNLASDLVLSREEKDKVDTSITNLAYNLNRFFNEEIESHFKFGSYTRGTILPRKADGNSDIDYMVIFNNPYNYKPQTLLNHLRKFVEKYYSRSEVYRSHPTIVLELRHIKFELVPAKKDWLGNIYIPSPASSYEDWMLTDPNAFNEKLTRVNTSNGNRIKPLVRLMKYWNRMNGGHLSSYELENWIVNQSYFFCNNLKECVYHVFEILSYNLSDPNTYKQKVDRAKRIIKDVKYYEDRNMPFSAKQEMMKLFPDFE

SEQ ID NO: 4590 - protein, 262 aa, Paenibacillus borealis
MSVQSYLESLAYQLILRDSEKVKIDSSVSTIKSRVGAYFSGQLNDHFAFGSYTRGTMLPREADARSDVDYMVIFTNPNKYKPQTLLNHLKLFAEYYYSRSEIKQSHPTMVLELQHIKFELVPAQKDWFGDIYIPSPSSSYTEWMRTTPNTFNQKLTRKNTDNYNYIKPLVRLMKYWNRQNNNHFSSYELENCITDLSFIWCTGFKAYVYHTVESLSYNWNDSQDKQNRINRAKQIIKDTKYYESVGYSASAEQEIKKLFPEV

SEQ ID NO: 4591 - protein, 262 aa, Paenibacillus sp.
MSVQSYLESLATQLIIRDEEKARINTSVSTIRSRIASYFGDNITDHFAFGSYTRGTMLTRSADMYSDVDYMVIFKNPNNLKPQTLLNHLRSFAESYYGRSQIKQSHPTMVLELQHIKFELVPAQKDWFGNISIPSPSSSYNEWMSTSPNAFNKKLTDKNTVHGNHIKPLIRLMKYWNCKNNYHLSSYELENAITDLWFFGTKNLKDYMYAGVDALSYSWLSSQDRKDRVDRAKRIVAEAKRLEAAGYPASAEIEIKKLFPPL

SEQ ID NO: 4592 - protein, 138 aa, Candidatus Brocadia sinica
MSVNTHLADLASNLVLSDSEKSSISASITTLESRLDAYFGSNITERFQFGSNTRGTILPRKADSNSDIDYMVVFDTSDGQKKPQAYLDRLKKFSETKYSTSEISQSNPTIVLSLNHTKFELVPALNNYGYQIPSPASS

SEQ ID NO: 4593 - protein, 261 aa, Desulfobulbaceae bacterium
MTVSTHLTTTASSLVLSETEKTDISRSITTLSSRLDAYFGNNITSHFQFGSNTRGTILPRKADSNSDIDYMIVFDTSDGQKKPQTYLDRLRRFAAAKYSTSEISQSSPTIVLSLNHIKFELVPAIYSYGYQIPSPASSWQEWVATNPSGANQAIQDKNKAENYQIKPLVRLIKYWNATQGHLFTSFSIEEYIVGKCFWSCTTLRDYFYAFWNDFNCSYESSQNTKDRVVRAKKYAENAKQYENDGMPATAEAEIKKIVPAL

SEQ ID NO: 4594 - protein, 261 aa, Desulfurispirillum indicum
MTVNSYLVNLASDLVLSSTEKSNITTSINTLSSRLEAYFGGGINEKFQFGSSCRGTILPRKADKKSDIDYMVIFDTSDGQKKPQTYLDRLRRFAENKYSRSEISQSSPTIVLSLNHIRFELVPAVYSYGYLIPSPRSSWEEWMSTDPTSANRQISDKNTAENNKIKPLVRLVKYWNATQGYPFASYDLEKYIVNQSYWFCTSLKDYFYDFWQNFSCTYDTPQYIKDKVERAKNYATKAKQYEADDMPVSAEIEIKKIVPIL

SEQ ID NO: 4595 - protein, 263 aa, Desulfomonile tiedjei
MSVNSYLTDLASDLVLSAAEKASIATSIATLKTRLDSHFGSQVTGHFQFGSSTRGTILPRKADNNSDIDYMVVFASSPGSAKKPQTYLTNLKTFVEAKYSTSERAQSHPTIVLSLNHISFELVPALSNLFGYQIPSPASSWTEWMSTDPSRTNKDLQDKNINNNSQIKPLVRLVKYWNAKNAHPFNSFSIEKAIIDTLFYSCSSLKDYFYHFWSTASYSVDTAQYIKDKVDSAKKHAQKAKEYEDIGLAISAELEIKKIVPEL

SEQ ID NO: 4596 - protein, 260 aa, Dehalogenimonas formicexedens
MSVLSHLTDTASSIVLSDTEKGSIQRSIKTIENRLDSYFGQELSLHFTFGSHTRETILPRKIDSSSDVDYMIVFKDNSYKPQTYLDRLKRFVEYYYSTSEISQSFPVIALDLEHIKFELVPAILDWGMYKIPSTNNYTGEWMSTDPIGFNSSLIQKNVDNNYQIKPLIRIIKYWNALNGVFTSFPLEKYIVDKWYFSCNNVKDYVYSVFESIELNQNASQTSKNKLQRAKDVISATKLYENNNMPYTAESEIKKIFPVIP

SEQ ID NO: 4597 - protein, 260 aa, Shewanella sp.
MSVQSYLAERSSNAILSDTEKSSISTSILTLETRLNTYFGDQISKQLQFGSSTRGTILPRSMDSNSDIDYMIVFKDEELRPQTYIDKLRRFANHYYTNSNIAQSHPTVVLELNHIKFDLVPAIKSYMEEYRIPAPSSSYAEWLATAPTAFNTTLTTANTQSNYKLKPAIRLLKFWNAQAGYVFDSYSLEQWAAARYYFLCTTVKDYLFSMIEGLNLDWDAAQWRKDKLNRAKKIVADTKEYEANSMPYTAEDEIKKLIPA

SEQ ID NO: 4598 - protein, 256 aa, Clostridium sp.
MSVNTYLQSLASSLVLSTSEKDSITTSVNTIKSRLDGYFSDVVEKKVFGSYFRETILPRKVDEKSDVDIMVVFNNPYGDKPQSFLERLKKFAEYYYSSSEIHQSSPSLVLELNHIKFELTPAYKNYGIYYIPDGSSNWRTTDPDGFSDTLIECNKNNGYKIKPVVRLLKHWNIQKNGRDLPSFLLEKTIAEELKYSYFSCTSYTDYLKAGLEKIKYKTDYNKVNNALEHIIQALSYEQQNMPYSAEVEIKKVFPEI

SEQ ID NO: 4599 - protein, 256 aa, Clostridium sp.; identical to SEQ ID NO: 4598

SEQ ID NO: 4600 - protein, 257 aa, Clostridium phoceensis
MSVNSYLSGLASNLVLSNTEKSNISTSVDTIKTRLSWYLSNEVVEKKIFGSYVRGTILPRKVDEKSDVDIMIVFNNPYGYKPQTFLNKLKSFAEKYYSSSEIYQSSPTVVLELHHIKFELTPAYVEYGMYYIPNGPSDWMYTDPDGFYSTLTECNVNNASKIKPVVRLLKHWNIQKNYRNMASFSLEKKIAEEMMYAYFGCTTYTDYLKKALNTIKYSTNYSRVDTAIGHIDAALNYEKQGLPYSALLEIKKAFPEV

SEQ ID NO: 4601 - protein, 257 aa, Intestinibacter bartlettii
MSVNSYLQSLGSSLVLNSSEKSSITKSIDTIKSRLTSYFGDEVIDKIVFGSYTRETILPRKADEESDIDLMVVFKNPYNYKPQTFLNRLKSFAEAKYSRSEIYQSSPTIVLELNHIKFELVPAKILYGMYYIPKNSSEWMYTNPNDFNEKLIKCNKNNYYKIKPVIRLLKHWNIKNNSRQLSSFELESKIADEMAYAYISCTSYTDYLISGLNKFRTYYDDSQINKTIKKINEALDYEKNNYPYTALSKIKEIFPEV

SEQ ID NO: 4602 - protein, 257 aa, Intestinibacter bartlettii; identical to SEQ ID NO: 4601

SEQ ID NO: 4603 - protein, 257 aa, Clostridium grantii
MSINSYLHDLGSSLVLNSNEKSSITTSINALKTRLTSYFGEDVIDKIIFGSYTRETILPRKADENSDIDLMVVFKNPYSYKPQSFLNRLKSFAEAKYSTSEIYQSSPTIVLELNHIKFELVPAYNFYSLYYIPKNSSEWMYTNPNDFNNKLVECNKNNTYKIKPVIRLLKHWNIQKNSRGLSSFELESKIAYEMTYSYINCTSYTDYLKSALGKLRTYSNATKIDNAVAKINEALRNENDGYPYTALSKIKEVFPEV

SEQ ID NO: 4604 - protein, 261 aa, Clostridium sp.
MSVNTYLSDSASNLVLSTKEKESITTSINTLEIRLESYFGANIEEKFKFGSYTRVTILPRKVDEESDVDYMVVFDNSNNYTPQTFLDRLKRFAETKYSTSEIYQSSPTIVLELNNIKFELVPAYKNWGTYYIPDGKGGWMPTYPNDFNNTLTETNNNNSYKIKPLVRLIKHWNINVNYRDLTSYRIEECIANNMKYSYITCTSYTDYAKKAFNELKNLTYDASITNRINRAIERIDKALEYENDGMPYSALSEIKKVFPEV

SEQ ID NO: 4605 - protein, 214 aa, Unknown
  Description of Unknown: Coprobacillus sequence
MSVNSYLSSCASNLVLSSTEKDSISTSINTLETRLTSYFGYNIKEKFKFGSYTRGTILPRKVDDNSDVDYMVVFDNSENYKPQTFLNRLKKFAETKYSTSEIYQSSPTIVLELNHIKFELVPAYKSWGTYYIPDGKGGWMATYPNDFNNTLVEANNNNSYKIKPLVRLIKHWNVNVNYHDLTSYEIEKIISENMKYAYFTCTSYTDYAKKHSIY

SEQ ID NO: 4606 - protein, 261 aa, Lactococcus lactis
MSVDSYLANLASEMVIRDSKKESISLSISTLHSRLKEYFGKDIIDVIKFGSYTRGTILPRRYDDKSDVDIMIVFNNDYDYKPQTFLDRLKKFAQQKYSTSYVYQSNPTIVLELNHIKLELVPAVKIYSWSDDYYNIPYNSSSWLVTRPKAFDNLLVECNKNNLNKIKPIVRLIKHWNIVNNYRDADSYQLEKKIAEEMKYSYFSCSSYSDYIKQALQVIRLYSSEYRIDLAISRIDKALNLEAEGYPYSAESEIKKVFPGI

SEQ ID NO: 4607 - protein, 261 aa, Lactococcus lactis; identical to SEQ ID NO: 4606

SEQ ID NO: 4608 - protein, 261 aa, Lactococcus lactis
MSVDSYLANLASEMVIRDSKKESISLSISTLHSRLKEYFGKDIIDVIKFGSYTRGTILPRRYDDKSDMDIMIVFNNDYDYKPQTFLDRLKKFAQQKYSTSYVYQSNPTIVLELNHIKLELVPAVKIYSWSDDYYNIPYNSSSWLVTRPKAFDNLLVECNKNNLNKIKPIVRLIKHWNIVNNYRDADSYQLEKKIAEEMKYSYFSCSSYSDYLKQALQVIRLYSSEYRIDLAISRIDKALNLEAEGYPYSAESEIKKVFPGI

SEQ ID NO: 4609 - protein, 261 aa, Lactococcus lactis
MSVDSYLANLASEMVIRDSKKESISLSISTLHSRLKEYFGKDIIDVIKFGSYTRGTILPRRYDDKSDVDIMIVFNNDYDYKPQTFLDRLKKFAQQKYSTSYVYQSNPTIVLELNHIKLELVPAVKIYSWSDDYYNIPYNSSSWLVTRPKAFDNLLVECNKNNSNKIKPIVRLMKHWNIVNNYRDADSYQLEKKIAEEMKYSYFSCSSYSDYLKQALQVIRLYSSEYRIDLAISRIDKALNLEAEGYPYSAESEIKKVFPGI

SEQ ID NO: 4610 - protein, 130 aa, Bacteroidetes bacterium
MEVGINNHLKKISSRLLIKPKSLTGINIARSVDSISRNIQTYFQEDVTHVMVFGSYSRDTLLPREYDSNSDVDILILFASENGKLKPESYRERLKKFASQHYQHGKVVKDHPSIVVELDHINFDLVPGIF

SEQ ID NO: 4611 - protein, 267 aa, Sphingobacteriales bacterium
MDIGLNNHLKRISSDLFIKYSSVEREKIDKSVNNIIDKLDEYFDDEIDEPILFGSYTRDTILPRRFDPNSDIDILIQFNTEDYDKLKPESYRSQLKRFAEENYPYSIVVKDHPSIVLELNHIKFDLVPAIFDKGIFYDSIEIPNKNGGWMETEPDKFNDDLKKVNTRYNSIVKPIIRLIKYWNASHGYPYFSFELETAIADMDFSNDNLESGFLYAIKKMPVDNLPDWAAKKVDVLKSDAKWVKEYLEREEISKAKKSLERILPSFL

SEQ ID NO: 4612 - protein, 263 aa, Bacteroidetes bacterium
MASLNYYITKISQELFISHSSPERKSIDTSLNYLRANIKTYFGNQVNQVIAFGSYTRGTIIPRKYDLNSDVDLMIEFNISNYSEKTPETYRNNLKRFVDTKYPRSISTKDLPSIMLELSKIKFDLVPAITYTSWLSSSIYIPKSGNEWQETDPKGFNTKLTESNQKYKNIVKPIIRLLKFWNHINNYPYESYELEKIIADMNFSGDTIETGFYYAIDNLPTYWRTESTKQKVQTLRNNKDWIIEYLNRNNIDKAKEAFHRIVP

SEQ ID NO: 4613 - protein, 265 aa, Flavobacterium fryxellicola
MASINSRLQTVSSDLFIKYNSTERTYIESKITNLKANLIAWFGSSISEILVFGSYKRDTILPRKFDDYSDVDILVVFTNAEQERTPETYRTRLKKFADAKYPTSKVLKDHPSIVLEMNKIKFDLVPSRKSLSWFSNTYQIPNKSGYWMDTDPIGFNTAVTEVNTKYNSVVKPLIRLFKRWNAHNNYPFTTYDLERKIAEMNFSGDNHQKGFLYAIDQLSTSGLTLVGTQKVETLKTNGKWIKEYLERDNQEKAIEVTCRILGIMP

SEQ ID NO: 4614 - protein, 265 aa, Flavobacterium branchiophilum
MASINSRLQTVASDLFIKYNSTERTYIEEKITNLKANLNAWFGNSISEILVFGSYKRDTILPRKFDDYSDIDILVVFSNAEEERTPETYRTRLKKFADTKYSTSIVLKDHPSIILEMNKIKFDLVPSRKSLSWFSSTYQIPNKSGYWMDTDPIGFNSEVTASNTKYNYIVKPLIRLFKRWNAHNNYPFTTYDLERKIAGMNFSGDNYQKGFLYVISQLSTYGLTLVGAQKVETLKTNGNWIKEYLDRDNQEKAIEVTCRILGIMP

SEQ ID NO: 4615 - protein, 268 aa, Hippea jasoniae
MATINNLLKVLSEQLFISYNSSEREKIETSVKTIKKRLKSYFGNEIKEIELFGSYTRGTILPRRFDEGSDIDIMIIFSTGEEEYLPETYRNKLKRFAEYYYSNSEIYKDFPTVVLELNHIKFDLVPAIEKDYIFFSSLYIPNSQNEWIETNPKDLNNKLTEVNKNNNFIVKPLVRLFKFWNVNNGKVYSSFELETNIIEIAESWIFSKNYEDGFFSIIDKLPMWHLPDYKKSKVESLKNNAKWVKYYLERDNLEKAKQWLKKIIPFED

SEQ ID NO: 4616 - protein, 268 aa, Chryseobacterium taichungense
MAVTINNYLRQLSSDIYLKNDSIEVIKIENSITNLFKNLNTDLGSLMNRSFIFGSYDRDTILPRKYDSKSDVDVMVVFNHTDDERTPETYRSWLKLFADKYYKDRYGSEVIKDFPTVTIKLNNIKYDLVPAKEEKLIYSSILYIPGDYGWQTTDPTDVKNELTRVNKQYNSIVRPIIRLLKAWNCKAGYPMESYDLELQVTKMNFFGDNIEKGFLWAANRLSISSYSAQWKKDKLTTLSNSSYKIEKFLESDDVFNAIGELHKLLPYS

SEQ ID NO: 4617 - protein, 222 aa, Chryseobacterium taichungense
MNRSFIFGSYDRDTILPRKYDSKSDVDVMVVFNHTDDERTPETYRSWLKLFADKYYKDRYGSEVIKDFPTVTIKLNNIKYDLVPAKEEKLIYSSILYIPGDYGWQTTDPTDVKNELTRVNKQYNSIVRPIIRLLKAWNCKAGYPMESYDLELQVTKMNFFGDNIEKGFLWAANRLSISSYSAQWKKDKLTTLSNSSYKIEKFLESDDVFNAIGELHKLLPYS

SEQ ID NO: 4618 - protein, 267 aa, Flavobacterium rivuli
MAVSIDSYLRSLASGYYLKNDSEEIRKINSSIASLLANLDKELGILIKRRFIFGSYDRDTILPRKYDSKSDIDIMVVFNHTDYERTPDTYRGWLKNFADKYYKDRYGSEVVKSFPTVAIRLNNISYDLVPAKEEISYYNSSVYIPGNLGWRTTDPNDVKQKLIDANTKYNQIVRLLIRIMKAWNCYNSFPYDSYLLELQITGMNFYGDNVQTGLFYLVNQLSANWSDPQSKKDKVTSLQYNLRQVKSCLENNDLDGAKRWLHRVLPY

SEQ ID NO: 4619 - protein, 268 aa, Flavobacterium psychrophilum
MAVIIDNYLRGLASSYYLKNDSEEVRKINASITNLLSNLDKELGVLIKRRFIFGSYDRDTILPRKFDSKSDIDIMVVFNHTDYERTPDTYRGWLKNFAVKYYKDRYGSEVVKSFPTVTIKLNNISYDLVPAKEETLFYTSTIYIPGNEGWRTTNPHDVKQKLTDANIRYNNVVRPLIRIMKAWNCHNGFPYDSYLLELQITEMNFFNDNIQTGLFYLAGQLNASWSDPQSKKDKINSLRYNLQQVQNSLENNDSETAKRWLHRILPYA

SEQ ID NO: 4620 - protein, 266 aa, Elizabethkingia miricola
MAASINNYLKELSSSYYLKNDSEEVKKINASLSGLFANLDKDMGALINRNFVFGSYDRDTILPRKFDSKSDIDVMIVFNHTEYERTPETYRNWLKLFADDYYKDRYGSVVVKSFPTVTIRLGHIYFDLVPAKEEKTWYNSTLLIPGNSGWRVTNPNDVKQKLTETNTKFSQIVRPIIRLLKAWNCNNGYPYDSYLLELKITKMNFWGDNIQTGFFYAVDQLGPNWSDSQSKAEKIRSLQYNIGEVKKALEINDTIKAKRWLHRVLP

SEQ ID NO: 4621 - protein, 268 aa, Cellulophaga lytica
MASSIDTYLRSLSYSFYLKKDSAEITRINTSKDNLLANLDKELGTLIKRRFVFGSYDRDTILPRSIDSKSDIDIMVVFNHTQYERTPETYRTWLKNFGDKYYKDRYGSEVIRSFPTVTIRLGNIHYDLVPAKEETQIWSSTLYIPGAYDWQITDPNDVKTKLTEANTRYNQLVRPVVRLMKAWNCNNGYPFDSYKLELFITRLNYFNDNVQSGFFYAVGQLSTEWSDPQTKKDKVTSLKYNIGKVKECLDKYETNEAKRWLHRVLPYG

SEQ ID NO: 4622 - protein, 264 aa, Rhodobacteraceae bacterium
MSINSYLMALSKHAILSSAEKTSINISIASISTRLKSFFPNELETHFRFGSSVRRTILPRKYDLRSDIDYLVVFNDGQFTPQTYLDRLKRFSNFYYKTSVVRQDFPSVTLNLNHIKFDLVPSVNYWWSGYKIPNNSGNWIETDPNGFSKELETKNVGCSSLIKPCIRLLKIWNAKAGYVFDSYDLEQQVAQMGFLWVDNNLKAYVFHSFRQLHLSVFTASWKIEALGRLKRRLDRIEVLSGQGFEGSAQKLMSEVFIQPSKTAT

SEQ ID NO: 4623 - protein, 265 aa, Alphaproteobacteria bacterium
MSVNTFLTDLASSAILSEEERAGINRSVEALTKRLQTHFEDKDIKEISVFGSYSRGTILPRKIDSKSDVDVMIVFADKWAKPQTYLDRLKRFSESQYSTSEIAQSHPTIVLDLHHIRFELVPAIDTIFNNLRIPSRSNKTQDWLNTEPAEFNSKFTQTNLRFSGLIQLLSRLFKIWNIGADRPLESFDLEQQVVEKNSRRMTTTKLSALFFETAQWLPDQVQKGSSQHAKLTRLGDLCRHAQELEKSGYADAAVALVTLLFPVDR

SEQ ID NO: 4624 - protein, 263 aa, Faecalibacterium prausnitzii
MSLNTYLDNTASNLIIKGDEKDAIAKSLDVFKSRMENYFFWNETVNLKEIKVFGSYARDTDLPQAIDSGTDVDIMLVMDDDGATPQTYLDRVRRAVEAKYSTSDIKQSSPTIVLQMNHIKFEITPAIQSYSQYKIKDQWSGWMYTNCLTDFVNLKTANTNNYCKIKPVIRLVKYWNKTRNGRGFASYQIEKNIVDYYQSNRHQEYDTKRYLLTALQCLRSLPIYEFQRKTLESAISNVQEAINDEEQFPTSAMSELKKVIGEL

SEQ ID NO: 4625 - protein, 263 aa, Clostridiales bacterium
MSINSYLEETASNLIIKGNEKESINVSLNTFIDRMRDYFSNNESVNLKEIKVFGSYQRDTNLPQSVDYGTDVDIMLVMDNDGATPQTYLDRARRGIEAKYSTSQIRQSSPTVVLQMLHIKFEITPAIMDGGLYRIKNNRNEWIYTFCATDFSNLITANRNNHYMIKPLLRLLKYWNVSKNCKAFSSYELEKIIVNYYQSSQYQGYDLKKYLLTGMNELYKLSTYNYQKERLDKAIYNIQEAIKDEEKYPSCAMSEIKEVIGEL

SEQ ID NO: 4626 - protein, 263 aa, Anaerostipes hadrus
MSINRYLEETASKLIIKGNEKESIDVSLNTFKDRMRDYFSKNESVNLKEIKVFGSYQRDTNLPQSVDYGTDVDIMLVMDNDGSTPQTYLDRVRRGVEAKYSTSQIRQSSPTVVLQMLHIKFEITPAIMDSGLYRIKNNRNEWIYTFCATDFSNLTIANKNNHYMIKPLLRLLKYWNVSKNYKAFSSYELEKIMVNYYQPSQYQGYDLKKYLLTGINELYKLSTYNYQKERLDKAIYNIKEAIKDEEKYPSCAMSEIKEVIGEL

SEQ ID NO: 4627 - protein, 263 aa, Blautia obeum
MSINRYLEETASKLIIKGNEKESIDVSLNTFKDRMRDYFSKNESVNLKEIKVFGSYQRDTNLPQSVDYGTDVDIMLVMDNDGSTPQTYLDRVRRGVEAKYSTSQIRQSSPTVVLQMLHIKFEITPAIMDSGLYRIKNNRNEWIYTFCATDFSNLTIANKNNHYMIKPLLRLLKYWNVSKNYKAFSSYELEKIMVNYYQPSQYQGYDLKKYLLTGMNELYKLSTCNYQKERLDKAIYNIKEAIKDEEKYPSCAMSEIKEVIGEL

SEQ ID NO: 4628 - protein, 171 aa, Campylobacter jejuni
MSVNSYLENLAKEAIVRDNEKTKIQTSIRTIKERLENYFGSELESVFLFGSYRRNTIISRKFDDNSDVDIMVVFKTNGYQLYKPETYINKLKDFMKQKYFQSEIYRDYPTAVLELNHIKFELVPAIKNYTIDYQIPCKDVYRDWMNTNPNDLDGALVNNQTLRRLVRICLL

SEQ ID NO: 4629 - protein, 247 aa, Campylobacter jejuni
MSVNSYLENLAKEAIVRDNEKTKIQTSIRTIKERLENYFGSELESVFLFGSYRRNTIISRKFDDNSDVDIMVVFKTNGYQLYKPETYINKLKDFMKQKYFQSEIYRDYPTAVLELNHIKFELVPAIKNYTIDYQIPCKDVYRDWMNTNPNDLDGALVNNQTLRRLVRIAKIWNARQDYIYKSYELEKWIVNNRFYGNLSDCFYQFCELLPINWNLSENKQNKIQRLKVFAQNTKCSDNEIYLQGLFE

SEQ ID NO: 4630 - protein, 247 aa, Campylobacter jejuni
MSVNSYLENLAKEAIVRDNEKTKIQTSIRTIKERLENYFGSELESVFLFGSYRRNTIISRKFDDNSDVDIMVVFKTNGYQLYKPETYINKLKDFMKQKYFQSEIYRDYPTAVLELNHIKFELVPAIKNYTIDYQIPCKDVYRDWMNTNPDDLDEALVNNQTLRRLVRIAKIWNARQDYIYKSYELEKWIVNNRFYGNLSDCFYQFCELLPINWNLSKNKQNKIQRLKVCAQNTKCSDNEIYLQGLFE

SEQ ID NO: 4631 - protein, 247 aa, Campylobacter coli
MSVNSYLENLAKEAIVRDNEKTKIQTSIETIKTRLKNYFGDEIENAFLFGSYKRKTIISRKFDDNSDVDIMVVFKTSNYQLYKPKTYINKLKDFMKQKYFQSWIYRDYPTAVLELNHIKFELVPAIKNSTIDYQIPCKDIYHDWMNTNPNDLDGALTNNQTLRRLVRIAKIWNARQDYIYKSYELEKWIVDNHFYGNLSDCFYQFCELLPINWNLSENKQGKITRLKTSARSTKCKNNEIYMQDLFK

SEQ ID NO: 4632 - protein, 247 aa, Campylobacter lari
MSVNSYLNNLAEEAIVRDNEKTKIQTSIKAIKERLEIYFGSELESVFLFGSYKRGTIISRKFDDNSDVDIMVVFKTNGYQLYKPETYIKKLKDFMKLRYSQSEIYKDYPTAVLELNHIKFELVPAINHYLNGCQIPCKDIYYDWMNTNPNDLDGALVNNQTLRRLVRIAKIWNARQGYIYKSYELEKWIVNNYFYGNLSEYFYQFCELLPINWNLSENKQNKIRRLKVSAQNTKCSDNEIYLQGLFE

SEQ ID NO: 4633 - protein, 247 aa, Campylobacter jejuni
MSVNSYLNNLAEEAIVRDNEKTKIQTSIKAIKERLEIYFGSELESVFLFGSYKRNTIISRKFDDNSDVDIMVVFKTNGYQLYKPETYIKKLKDFMKLRYFQSEIYKDYPTAVLELNHIKFELVPAINHYLNGYQIPCKDKYYDWMSTNPNDLDGALCNNDTLRKLVRIAKIWNARQGYIYKSYELEKWIVNNYFYGNLSEYFYQFCELLPINWNLSENKQNKIRRLKVSAQNTKCSDNEIYLQGLFE

SEQ ID NO: 4634 - protein, 247 aa, Helicobacter sp.
MSVNSYLNNLAEKAIVRDNEKTKIQSSIRAIKERLESYFRKEIESAFLFGSYNRKTLISRKFDDNSDIDIMVVFKTNGYQSYKPEAYINKLKDFMKSRYPQSEIYRDYPTAVLELNHIKFELVPAINHYMSGYQIPCKNTYRDWMNTNPNDLDGALANNQTLRRLVRIVKIWNAKQGYIYEAYELEKWIVNNCFYGNLSDHFYRFCELLPINWNLSENKQNKIQKLKDSAQMVKYSDNENCIQNLFE

SEQ ID NO: 4635 - protein, 272 aa, Helicobacter apodemus
MSVNSYLNNLAEKAIVRDNEKNKIQVSIDTIFQRLQQFDENDEFSITPRNQIEKYFIFGSYKRKTIISRQFDENSDIDIIVIFGKKFEGFLSFEPRNNYPKNPQTYLQKLRDFIELRYPNSLCKQSFPAVVLELNHIKFDLVPAIIDDFGDYKIPNKQNWYQTKVLDWITTNPNDLDDALVNNQTLRRLVRVAKIWNAKQGYIYESYELEKWIVGQYFYGDLENHFYRFCELLPINYNLSQEKKNQIQRLKDLVRKVQYSSDDENCIKCLFE

SEQ ID NO: 4636 - protein, 280 aa, Helicobacter sp.
MSVNSYLNDLAERAIVRDNEKNNIQVSINTIFRRLQQFDESNEISITPRNQIEKYFVFGSYKRKTIISRQFDENSDVDIIVVFGKIFGGFYRLEPRNNYPKKPQDYLDYLKEFAESKYPTSICKQSFPAVVLELNHIKFDLVPAIIDDFGDYRIPNKQNWYQTRVWDWISTNPNDLDRELVNNQTLRRLVRIAKIWNAKQGHIYESYELEKWITQQCDLSKRPFLRGDYSLSEYFYRFCELLPICWDLPEYKQNKIERLQEDAKKAKYHDNEIYIKNLFE

SEQ ID NO: 4637 - protein, 273 aa, Helicobacter pullorum
MIVNSYLNDLAQRAIVRNNEKESIQISIDTILQRLKGYDENVDMFSPKKHQIDKTLIFGSYKRKTMLSRIFDDNSDVDIMVVFGKKFQGFYSLEPRNAKTKSPKTYLNYLKDFAENKYPTSLRRQDFPTIVLELNHIKFDLVPAIIDDWGQYKIPRKRTSSDFCQIDEWIPTNPNDLDGALSNNQTLRRLVRVAKIWNAKQGYIYELEKWIIHNSFYGNPNENLAQHFYRFCELLPINLNLSQENQRKIQKLKDSAKNAKYSDDKSTIQDLFE

SEQ ID NO: 4638 - protein, 267 aa, Helicobacter pullorum
MSVNSYLNDLAQRAIVRNNEKESIQISIDTILQRLKSYDENKYQIGNTLIFGSYKRNTMLSRKFDEDSDVDIMVIFGKKAMGFYSFEPRNNQPKSPQTYLNYLKDFAESKYPTSLRRQDFPTIVLELNHIKFELVPAIIDDWGQYKIPNKPKDWYSTQEWISTNPNDLDGELCNNQTLRRLVRIAKIWNAKQGYIYESYELEKWIIYNSFYGNPNENLAQHFYRFCELLPINLNLSQENQRKIQKLKDSAKNAKYSDDKSTIQDLFE

SEQ ID NO: 4639 - protein, 242 aa, Campylobacter sp.
MSVNSYLNVLAQGAIVRDSEKNKIQVSVNAIKERLEQHFTSEIDKVFLFGSYKRGTIISRKFDENSDIDIMVVFNDNSYKPQTYLNWLKEFAESSYFRSQIYQSFPSVVLELNHIKFDLVPAIICGDKYKIPSKQNSDWITTNPNDLNGALINNQTLRRLVRVAKIWNAKQELIYDSYELEKWIVGKTFNGNLAKYFYRFCELLPINYNLSQEKKNKIQKLKDLARKAQDSNNKNCIKGLFE

SEQ ID NO: 4640 - protein, 262 aa, Helicobacter japonicus
MSVNSYLNDLAERAIVRDNEKNKIQVSVKAIKERLEQHFSSEVDKVFIFGSYKRGTIISRQFDENSDIDIIVIFGKKFGGFYHLEPRNNYPKNPQTYLQKLRDFIGLRYPNSICKQSFPAVVLELNHIKFDLVPAIIDDFGDYKIPNKQNWYQTQVWDWITTNPNDLDGALANNQTLRRLVRVAKIWNAKQGRIYDSYELEKLIVRQSFYGDLGEHFYRFCQILPLDYSLSQDKQRKILKLRDSAAQANYNNDESYIKGLFE

SEQ ID NO: 4641 - protein, 265 aa, Sphingobacteriales bacterium
MAAISINNRLITFAQQELVLGYSSTERDRISSSLAQLQKVLKDKLHNEAKEILPFGSFTRNTILPRKYDSNSDVDLLIVFNTSAGKKTPGTYRKNILDALSSSYPLSVVKKDFPTVKLELNHIMFDVVPSHIEEFWNKTYYIPSANDSWRTTVPNDINNELSQKNQSYGNNIVRNVIRLCKHWNSTQGRVFDSYEMEKWIVGRFFYSGDNLYEKFLSVLKDLAYYKHSGVKQAIDWITEYKGTWSRQADEQKQLEWLIKLLPGLN

SEQ ID NO: 4642 - protein, 277 aa, Nocardia nova
MFLERLTPLASHRAAAAAHRSRVETSLKNSLSVLVMRETGSFHHGTGVRHHSDVDILVSIGNPKPGSSDTALNWVKSALSASFPTTTVRISRPAVVVEFAGGAETWEVIPGFLKSSDPSPLYDIPGAASGWLESAPTVHLDYVNECNQKNGVQGAAKKLARLVKAWKYYCNVPVSSFYLEMRAAQHMATQAGFIAVWDVCLLLEDLRDNHLAAMNDPKGRTGRFHPCSSDYRKIDALSKLSTAATRARNALDAYQNDKFDDAFHYLDLLFSGQFPAR

SEQ ID NO: 4643 - protein, 287 aa, Amycolatopsis vancoresmycina
MAKTVAQGFDTFLERLTPLASQRTAAAAHRSRVETSLKNALSVLAMRETGSFHHGTGVRNYSDVDVLVSIGNTKPGTSDTALNWVKNALSASFPATTVRVSRPAVVVEFAGGAETWEVIPGFLRSSDPSVLYDIPGAASGWIESAPTEHLDYVNECNQKNGIQGAAKKLARLIKAWKYYCNVPVSSFYLEMRAAQHMATQSAFIAVWDMCLLLEDLHSNSLAAMNDPKGRTGRFHPCSSDYRKTDALSKLSTAATRARKALDAYQNDKLDDAFHYLDLLFGGHFPAR

SEQ ID NO: 4644 - protein, 292 aa, Amycolatopsis mediterranei
MIRTVNTAFEELLSRLTPTKPQRQAGARHRSTVTASLNASLKVTRFFETGSFSHGTGVRGYSDIDALVSLNMPRPQSSYTALTWVKDALTKTFPYTPINISRPAVVVKFGAGYETWEVIPGFITNRGAEKQLVYDIPGPSAGSAWIDSAPDEHLTYVNDANHKPHQGDAKDLARLVKAWKYYRSVPISSFYLEMRAAEHVKKQKHYIHVWDGCQLLESLDSIGLASMNDPKHAAGRIYACSSEANLKDAQTKLKRAAIRARAALDADLANKPDGAFYYLDKLFNGKFPARRY

SEQ ID NO: 4645 - protein, 289 aa, Mycobacterium sp.
MARTVNQGFEEFLKRLVPTGPEREAGASHRASVKSALERKLTVNNFFETGSFSHGTGVRPYSDIDALVSIGGSRPDSSYTALTWVKDALSQRFPSTNVTIRRPAVVIEFARGYETWEVIPGFLTLRGGSALVYDIPSPVTGGGWIDAAPKEHLAFVNECNHEPHEGDAKDLARLIKAWKYYGNVPVSSFYLEMRAAQHVKSVGAYIHIWDVCLLLEKLKGHGLANMQDPKGASAPFAATSSDATRQDALSKLNTAAARARKALDAYREDKIDTAFYYLNLLFAGQFPAR

SEQ ID NO: 4646 - protein, 289 aa, Unknown
  Description of Unknown: Mycobacterium sequence
MARTVDQGFEEFLGRLVPTTAQREAGVSHRASVKSALESRLKVNTMFETGSFSHGTGVRNYSDIDVLVSLGADRPGSSYTALTWVKDALEQRFPTTDVTIRRPAVVVNFAGGYQTWEIIPGFLTGRGGSALVYDIPSPVTGGGWIDAAPYEHLAYVNECNEKPGKGDAKALARLAKAWKYYCDVPVSSFYLEMRAAQHVKSIDAYIHVWDICLLLEKLRDHEFADMNDPKGAAGRFSATSSDSTREEAISKVKTAASRARKALEASRADDPSTAFHYLDLLFGGRFPAR

SEQ ID NO: 4647 - protein, 289 aa, Mycobacterium gilvum
MAKTVDQGFEEFLKRLVPTEAQRSAGASHRASVKGALESKLTVWNFFETGSFSHGTGVRHHSDIDALVSLGNSKPGSSYTALTWVKDALSARFPLTTVRISRPAVQVLFGGGYETWEVIPGFLTSSGDGAMIYDIPSPVTGGGWISAAPREHNDYVNECNKEPGQGNAKALARLVKAWKYYCNVPVSSFYLEMRAAQHVKSIDAYIHVWDICLLLEKLRDNELADMNDPKGASSRFSATSSDSMRADALSKVKTAATRARKALDAYRADDADTAFYYLDLLFGGQFPSR

SEQ ID NO: 4648 - protein, 290 aa, Mycobacterium grossiae
MARTVDQGFEEFLRRLVPTQAQRDTGASHRLSVEGALESRLNVSTFFETGSFTHGTGVRHRSDIDVLVSLGGTKPISSYTALTWVKDALGKRFPHTTVRIRRPAVQVLFGGGYETWEVIPGFITARGGENVLVYDIPSPVVNGGWIDAAPREHLAYVNECNAKPHKGDAKDLTRLIKAWKYYCDVPISSFYLEMRAAQHVKTQETYIHVWDVCQLLEKLNRHQLADMNDPKGASGRFGSTSSDSTRTEALSKLNTAAVRARKALNAEQDNDAATAFYYLDLLFGGNFPLR

SEQ ID NO: 4649 - protein, 291 aa, Rathayibacter tritici
MPERTIETAFEVLLSQNIPTAAERSAAARHRASIENSLSQLENFGLRETGSFSHGTAVRGHSDVDVLVSLGGGQPASSDTAMNRVRNALKQSFPFTPVRVSRPAVVVDFAGGDERWEVIPGYYLRASGDYSVYSIPAPGGGWMESAPSAHLTYVTDANRSPTGGAKGLARLMKTWKYANPGGAKVSSFYLEMRAAQRMADEASFFPHLDFAYLVNSLVRSGLADMNDPTGATGRFRAASTEAHRSIAVATLTRDAQRIADAFELEKAGKRASAFAKLDYVFAGTTFPSQFY

SEQ ID NO: 4650 - protein, 289 aa, Streptomyces sp.
MALTVFQAFDIFLERLTPLPSERDAKARHRLSVETSLKGSASFGVHRFRETGSFGHGTGIRNHCDVDLLVSMTGSKPTSDTALRWVKEALKASFPMTIVEIRRPTVVVRFAGGAEQWEILPGFRTSPQGETPVYDIPGPASGWMSSAPTAHLDYVNGVNQQAGILGGAKKLARLAKAWKYYNQVPISSFYLEMRAAQYMAAQASFSAALHLCGYLEWLDQIALADMNDPMGKASRFSACSSTTTKTTALSNLHTAATRARKAVTAEQAWNIRQALDYLDLLFGNQFPKP

SEQ ID NO: 4651 - protein, 218 aa, Streptomyces sp.
MALTVSQGFGIFLERLTPLQSERDAKARHRLSVETSLKGSTRFGVQLFRETGSFTHGTGIRNHCDVDLLVSMSGSQPTSDTALNWVKDALKASFPTTAVEIRRPTVVVRFAGGVEQWEILPGFRTSSQSETPIYDIPGPASGWMSSAPTAHLDYVNSTNQQVGVVGGTKKLARLAKAWKYYNRVPISSFYLEMRAAQYMAAQKSFSAALYFCGYLEWL

SEQ ID NO: 4652 - protein, 289 aa, Streptomyces rimosus
MALSVHQGFDSFLQQLVPTAGERDAKARHRRSVEASLEASPFGVFLFRETGSFTHGTGVRGHCDVDLLVSIKASRPNSSDTALGWVKSTLQASFPSTEVVVRRPTVQVRFNGGAETWEVLPGFVTLRGGDTPVYDIPGAAGGWLDSAPTAHLGYVNEVNQIPAVAGGAKRLARLAKAWKYYNNVPISSFYLEMRAAQYVAGISNFIPVWDMCLFLEKLSGHQLAAMNDPKNKAGRFTACSSEATRRDALSKLSTAATRARKALDAYQKNDHSTAFAYLDLLFGYHFPIR

SEQ ID NO: 4653 - protein, 289 aa, Streptomyces rimosus
MALSVHQGFDSFLQQLVPTAGERDAKARHRRSVEASLEASPFGVFLFRETGSFTHGTGVRGHCDVDLLVSIKASRPNSSDTALRWVKSTLQASFPSTEVVVRRPTVQVRFNGGAETWEGLPRVVTLRGGDTPVYDIPGAAGGWLDSAPTAHLGYVNEVNQIPAVAGGAKRLARLAKAWKYYNNVPISSFYLEMRAAQYVAGISNFIPVWDMCLFLEKLSGHQLAAMNDPKNKAGRFTACSSEATRRDALSKLSTAATRARKALDAYQKNDHSTAFAYLDLLFGYHFPIR

SEQ ID NO: 4654 - protein, 244 aa, Streptomyces rimosus
MFRETGSFTHGTGVRGHCDVDLLVSIKASRPNSSDTALGWVKSTLQASFPSTEVVVRRPTVQVRFNGGAETWEVLPGFVTLRGGDTPVYDIPGAAGGWLDSAPTAHLGYVNEVNQIPAVAGGAKRLARLAKAWKYYNNVPISSFYLEMRAAQYVAGISNFIPVWDMCLFLEKLSGHQLAAMNDPKNKAGRFTACSSEATRRDALSKLSTAATRARKALDAYQKNDHSTAFAYLDLLFGYHFPIR

SEQ ID NO: 4655 - protein, 121 aa, Streptomyces sp.
MALSVTQGFDLFLKQLTPRAGEREAKTRHRSSVEASLRAASFGVLWFRETGSFTHGTGVRGHCDVDLLVSIKAARPASSETALEWVKSALKSSFPYTEVVIRRPTVQVRFASGAETWEVLP

SEQ ID NO: 4656 - protein, 289 aa, Streptomyces sp.
MALSVDQGFTVFLDRLVPLQSQRDAAARHRAGIESSLRQAPFGVQRFREIGSSFGHGTGIRSYCDVDLLVSITASRPGSSDTALGWVRDALTHSFPSTEVVVRRPTVVVRFANGTETWEVLPAFRTSHDDPPVYDIPAAASGWMSSAPTAHLSYVNEINQRTGIAGGAKKLARLAKAWKYYNQVPVSSFYLEMRAAQHLAGERAFSPVWDICLLLEKLNTNQLAAMNDPQGLASPFHACSTDATRRDALSKVNTAAVRARKALNAHNADDPATAFYYLDLLFGGRFPAR

SEQ ID NO: 4657 - protein, 287 aa, Streptomyces sp.
MPKSLAVAIDEFLTKMTPSASQFSASSRHRAEVEGCINAAIGLNRSVETGSLRHGTGVSGYSDADYLVSLKGDMPSSPEAILAKIRDALASRFWATRIRVSRPAVVCAFANGTETVEVTPGYLHGTGEYFSYYIPQPGGTWMLSSPDAHLAYVNESAARFPSGKVKALIRLLKAWKYLNDVQMSSFYLEMRAAQHAMGESAIVHLIDLCMVFEDLAARALPDMNDPKRVGGRFSACSSDPRRLEALSKIRTAATRARRAVDASARGDEVAAFEQLNLLFAGRFPKRW

SEQ ID NO: 4658 - protein, 230 aa, Janibacter indicus
MFEIGSLRHGTGVWLYSDADYLVSLKGIRPDSPWTMLNKVKEQLQARFPSTTVVTRRPAVVCKFSDGDVEIVPGYPGSSDGYWIANPADGWMLTHPKDHNRYVTDVNTKHGGAVKKLARQVKVWKYKRNVPVSSCYLEMRTAKHMNGEKSYSPLWDLYLTLKKMRDAELAAMNDPTGLGSRFGSCSSEANRQDAMSKLNRAVSRALKAKDYAKDGYESLAIEQLKLLFNQ

SEQ ID NO: 4659 - protein, 274 aa, Janibacter indicus
MVTARQWLDDLTDYYTPSSSQFDGARGHRAAIEVRLDTYLGVREMFEIGSLRHGTGVWLYSDADYLVSLKGIRPDSPWTMLNKVKEQLQARFPSTTVVTRRPAVVCKFSDGDVEIVPGYPGSSDGYWIANPADGWMLTHPKDHNRYVTDVNTKHGGAVKKLARQVKVWKYKRNVPVSSCYLEMRTAKHMNGEKSYSPLWDLYLTLKKMRDAELAAMNDPTGLGSRFGSCSSEANRQDAMSKLNRAVSRALKAKDYAKDGYESLAIEQLKLLFNQ

SEQ ID NO: 4660 - protein, 276 aa, Mycobacterium sp.
MTDSTTARGWLDELSSYYIPSSTQFDGAKSHRSAIEARLDTYLGVREMFEIGSLRHGTGVFYYSDADYLVSLKGIRPDSPWTMLNKVKEQLQARFPGTTIVIRRPAVVCKFSDGDVEVVPGYPAASGYWIANPADGWMLTHPKDHNKYVTDINTKHNGAVKKLARQVKVWKYRRSVPVSSCYLEMRTAKHMDGESTYSPLWDLYLTLKKMRDAELAAMNDPTGLGSRFGSCSSEVNRLDALSKLNTAVSRAMKAKDYDHDGDQARAIEQLKLLFNK

SEQ ID NO: 4661 - protein, 273 aa, Mycobacterium porcinum
MATAQGWLRDLTDYYTPSSTQFDGARQHRSAIESRLDTYLGVHEMFEIGSLKHGTGVWLYSDADYLVSLKGVRPDSPWTMLNKVKEQLQARYLSTEVVVRRPAVVCRFSDGDVEVVPGYRGDVGYWIANPADGWMLTHPKDHNTYVTDINSKHNGAVKKLVRQVKTWKYLRNVPVSSCYLEMRTAKHMDGETAYAPLWDLYLTLKKMHDAGLAAMNDPTGLGSRFGACSSESNRLDAMSKLDTAVNRARRAKEFAHADEQDKAIAQLKLLFDK

SEQ ID NO: 4662 - protein, 274 aa, Microbacterium sp.
MTETAHSWLNSLTSLYTPTSTQFDAAKSHRASIESRLDAFVGVYEMFEIGSLRHGTGVWQHSDADYMVSLKGVRPSSPWTMLNRVKETLQARFSGTTIVVSRPAVVCYFSDGVVEVVPAYPSDSGYWIADPADGWMKSYPKSHNKYVNDVNTKHNGAAKTLARQLKIWKYLRNVPISSCYLEMRAAKHLDGESAYLPFWDLYLALDKMYDANLAAMNDPTGLGSRFGACSSEAKRLDVLSKLGFAVVRANKAREFESDGMHAQAIEQLKLLFNR

SEQ ID NO: 4663 - protein, 266 aa, Rhodococcus rhodochrous
MNSLTSLYTPTSTQFDAAKSHRASIESRLDAANGIYRMFEIGSLRHGTGIWQYSDADYLVSLKGDKPASPWTALTKVKEALQQRFQATTIVIRQPAVVCNFSDGVVEVVPGYISDSGYWIANPAGGWMKSHPEEHNKYVNTINSKHNGGAKTLARQLKIWKYLHNVPISSCYLEMRAAKHLDGESAYLPFWDLYFALDKMYDANLAAMNDPTGLGSRFGACSSEANRLDALSKLGTAVVRANKAREFESEGRHLQAIEQLKLLFNR

SEQ ID NO: 4664 - protein, 229 aa, Arthrobacter sp.
MFEIGSLRHGTGVWLHSDADYMVSLKGVMPGSPFTMLNKVKETLQARFASTRIVISRPAVVCYFSDGVVEIVPAYPSDSGYWIANPASGWMKSHPKSHNRYVADVNSKHGGAVKTLARQVKVWKYRRDVPISSCYIEMRAAKHLDGESGYSPLWDLYLSLKKMHDAGLAALNDPTGLGSRFGACSSDSNKSIALSKLGTAVTRALKAKDYDNAGKNSEAVEQLKLLFNK

SEQ ID NO: 4665 - protein, 238 aa, Microbacterium sp.
MDAEFGVREMFEIGSLKHGTGVWTYSDADFLVSLKGVRPDSEWTMLNKIKSSLKTRFPSTEVVVRRPAVVCKFSDGVVEVVPGYPGTTGYWIANPADGWMLTHPKDHNSYVNGVNSKHDGAAKKLARQIKVWKYRRNVPVSSCYLEMRAAKHMDGESSYSPLWDLHASLKKMHDVELAAMNDPTGLGSRFTACSSPANKSDALSKLDTAVTRARRAKEYASAGEDAKAIEQLKLLFNK

SEQ ID NO: 4666 - protein, 274 aa, Microbacterium hominis
MGDTPISWLSDLNAKYTPSSTQFDAARGHRASIESRLDSDLGVREMFEIGSLRHGTGVWIYSDADYLVSLKGIRPESIWTMLEKVKSSLETRFPSTTISTRRPAVVCKFSDGTVEVVPGYPSTTGYWIAHPSGGWMLTHPKDHNAYVNGVNSRHSGAVKKLARELKVWKYKRNVPISSCYLEMRAAKYMDGQNTYSAVWDLHGALKHLQDVGLAAMNDPTGLGSRFTACSSDTNKADALSKLNTAVARAGRAKAHWAAGESAESIDDLKLLFNQ

SEQ ID NO: 4667 - protein, 274 aa, Microbacterium hominis; identical to SEQ ID NO: 4666

SEQ ID NO: 4668 - protein, 274 aa, Microbacterium ginsengisoli
MGDTAIGWLSDLNAKYTPSSNQFDAARGHRASIESRLDSDLGVREMFEIGSLRHGTGVWIYSDADYLVSLKGIRPESIWTMLEKVKSSLETRFPSTTISTRRPAVVCKFSDGTVEVVPGYPATTGYWIAHPSGGWMLTHPKDHNAYVNGVNSRHSGAVKKLARELKVWKYKRNVPISSCYLEMRAAKYMDGQATYSAVWDLHGALKHLQDVGLAAMNDPTGLGSRFTACSSDTNKADALSKLNTAVARAGRAKAHWAAGENAESIDDLKLLFNQ

SEQ ID NO: 4669 - protein, 274 aa, Microbacterium sp.
MGDTPIGWLSDLNAKYTPSSTQFDAARGHRASIESRLDSDLGVREMFEIGSLRHGTGVWIYSDADYLVSLKGIRPESIWTMLEKVKSSLERRFPSTTISTRRPAVVCKFSDGTVEVVPGYPATTGHWIAHPSGGWMLTHPKDHNAYVNGVNSRHSGAVKKLARELKVWKYKRNVPISSCYLEMRAAKYMDGQDTYSAVWDLHGALKHLQDVGLAAMNDPTGLGSRFTACSSDTNTADALSKLNTAVARAGRAKAHWVAGKSAESIDDLKLLFNQ

SEQ ID NO: 4670 - protein, 129 aa, Micrococcus luteus
MYRMFKIGSLQHGTGVYQYSDADYLVSLKGIQPSSPLTMLTKVKEALQARFTSTTITIGQPAVDCHFSDGIVEVVPGYIASGGGDLIVDPRGGWMKSFPEEHNKYVNEINAKHSGGSSSGRVSRASHCS

SEQ ID NO: 4671 - protein, 171 aa, Micrococcus luteus
MTATATSWLNDFTSLFRPTATQFDGAKGHKTSIETRLDYLLGVYRMFKIGSLQHGTGVYQYSDADYLVSLKGIQPSSPLTMLTKVKEALQARFTSTTITIGQPAVDCHFSDGIVEVVPGYIASGGGDLIVDPRGGWMKSFPEEHNKYVNEINAKHSGGSSSGRVSRASHCS

SEQ ID NO: 4672 - protein, 138 aa, Micrococcus luteus
MYRMFKIGSLQHGTGVYQYSDADYLVSLKGIQPSSPLTMLTKVKEALQARFTSTTITIGQPAVDCHFSDGIVEVVPGYIASGGGDLIVDPRGGWMKSFPEEHNKYVNEINAKHSGGSSSGRVSRASQLFVVRPRGILR

SEQ ID NO: 4673 - protein, 232 aa, Armatimonadetes bacterium
MFEIGSLRHGTGVWQHSDADYLVSLKGSQPSSPWTMLNKVKESLQGRFPTTTIQIRRPAVVCQFSDGIVEVIPGYIFDGDDKGYRVASPIDGWMNTFPEKHNEYVNGINSTFNGGAKQLARFMKIWKYRRNVPVSSCYLEMRAAQHLSGEASYVPVWDIYQLLKKLHDHSLASMNDPSGLGSRFTSCSTDASKADAMSKLSTAVARAEKAKNYHRNEDHSNAIAQLELLFNR

SEQ ID NO: 4674 - protein, 278 aa, Cellulomonas carbonis
MTVTSWLSDLDSLYTPLRSQFDAARSHEGSIESRLDYMLGVYRMFEIGSLRHGTGVWRRSDADFLVSLRGSKPANSTSMLTRVREALVGRFTNTTVSVRSPAVVCNFSDCRVEVVPGYLADADAHHGYWIADPASPGGWMKTYPEAHTEYVNSVNRRFSGGVKTLARQLKVWKYERSVPVSSCYLEMRATKYMSTQDSYVPIYDLGFALREIHRAGLAAMNDPTGLGARFTACSSTATMSDALSKLSQAAARADKAIDHHRSGNEALAIEQLKLLFNR

SEQ ID NO: 4675 - protein, 287 aa, Actinomyces sp.
MSATAISTLESLIRTMTPDEAARSAAAKHRKEIEEWLMYDLGIIRMRETGSWHHGTALDGFSDVDYFVSMRNSRPSVSTTALEELRASLSRGIRGAYVSIDRPAVRLRYFEDGPDVEITPAYIRDTDDYDIPDPDSTGWIRSNPAVHLEYVDRAQKETDGRAKGLIRLVKTWKSWNNVPLSSFYLEMRTAQYVLNNMPIIYDWDLRDFFKSLANSGLREMNDPTNYGRRITTGTSNLAESITAKYAVEEAARLTRLAREAAEDSDHSTAIRHLCTLFNCERGEVSAW

SEQ ID NO: 4676 - protein, 250 aa, Unknown
  Description of Unknown: Actinomyces sequence
MYDLGIIRMRETGSWHHGTALDGFSDVDYFVSMRNSRPSVSTTALEELRASLSRGIRGAYVSIDRPAVRLRYFEDGPDVEITPAYIRDTDDYDIPDPDSTGWIRSNPAVHLEYVDRAQKETDGRAKGLIRLVKTWKSWNNVPLSSFYLEMRTAQYVLNNMPIIYDWDLRDFFKSLANSGLREMNDPTNYGRRITTGTSNLAESITAKYAVEEAARLTRLAREAAEDSDHSTAIRHLCTLFNCERGEVSAW

SEQ ID NO: 4677 - protein, 266 aa, Rothia sp.
MTPDESARTAAAKHRKEIEDWLTCDLGIIRMRETGSWHHGTALDRVSDVDYFVSMRGSRPSVSSTALEELRASLSRGIPGAYISIDRPAVRLRYFDDGPDVEITPAYIRDTDDYDIPDPDSTGWIRSNPAVHLEYVDRAQKETDGRAKGLIRLVKTWKSWNNVPLSSFYLEMRTAQYALNNKPIIYDWDLRDFFKSLANSGLREMNDPTNYGRRITTGTSNLAESITAKYAVEEAARLSWLAREAAEADDHPTAIRHLLTLFNYEL

SEQ ID NO: 4678 - protein, 281 aa, Kocuria flava
MSATALSTLESLIRTMTPDEAARTAAAKHRKEIEDWLTSDLGIIRMRETGSWHHGTALDRFSDVDYFVSMRDSRPSVSSTALEDLRASLSRGIQGAFVSIDRPAVRLRYFDDGPDVEITPAYYQDTDDYDIPDPDSAGWIRSNSAVHLEYVDRAQKETDGRAKGLIRLVKTWKSWNNVPLSSFYLEMRTAQYALGNKPIIYDWDLRDIFKSLANNGFREMNDPTNYGRRITTGTSNLAESITAKYAVEEAARLARLAREAAEADDHSTAIRHLLTLFNCEA

SEQ ID NO: 4679 - protein, 282 aa, Nocardiopsis dassonvillei
MTEATGRSALASIIRAMTPDEEARSTAAGHRASIESWLEQDLKIIRMRETGSWHHGTAISGSSDVDYFVTMPGTRPTDSWTALETVRASLARGLTDCGVHIDRPSVRVTYFDGGPAVEITPAYYKATDDYDIPDPAGTGWIRSNPAVHLNYVNRAQRDTDGKAKDLIRLVKTWKAWNSVPISSFYLEMRTAQYALANTIIIYDWDLRNLFKGLADGDLREMNDPTNYGRRIATGAHSLADSISAKYAIEKAARLAALAKDASDAGDHAVAVQYYIRLFSMQP

SEQ ID NO: 4680 - protein, 281 aa, Propionibacteriaceae bacterium
MTASTAWGTLDTIIKAMTPNADARAAASRHRSEIESWLKADLDIVRMRETGSWHHGTAVHGHSDVDYFVTMSGSRPNLSLDTLNVLRDSLQRGLTGFVRVNRPAVQVDFFDGGPKVEITPAYYRDTDDYWIPDPDGSGWIKSNPAVHLAYVNSVQEKTDGQAKGLIRLVKTWKVRRGVPLSSFYLEMRTAQYAPENKPILWDWDLAGVLRALQRSELASMNDPTDYGRRISCGATGLGEAITAKMQLDEAVRLATAAHDAAKAENHQSAVQHILDLFNFTA

SEQ ID NO: 4681 - protein, 281 aa, Zhihengliuella halotolerans
MSTDRDACAYLEEILREVTPDEEARKKAASHRADLGDWLKNDLGIVRMRETGSWHHGTAITRHSDVDYFVTMPGSRPSASWSALEEVRSSLARGVSSAIVRTDRPAVNLIYFDSGPSVEITPAYIRGTDDYDIPDPDGTGWIQSNPAVHLDYVNDAQKKTNSRAKSLIRLVKTWKARNSVPLSSFYLEMRVAKYALSSSPIIYDWDLRSFFKTLEGDGLREMNDPTSYGRRISTGADGVGEYVLAKLAIEQAVRSSSLALKVAQDGNPGLGVAHWRQLFKG

SEQ ID NO: 4682 - protein, 278 aa, Dermacoccus sp.
MRPEDFLTQVITDATPTARDRSAAARNRAALNRWAETTFMGNYGFRETGSWSHGTAVRSMSDVDYFLSLRGARPSASKDILESLRTSLATHLWRATVTINRPAVRVQFNDGSPDVEIVPAYLDFISDDYLIPDPVSTGWIRSNPRKHLAYVDSAQSKEPGAKKFMRLVKSWNHRQNVGLSSFYLEMRAAKHVLNNPPLLLLHDFCWLLDALHVGGLASMNDPSQFDGRRIEACPQVSRTDRARLVGLYADAARKARERANDGSYETAQVWLDFIFYPE

SEQ ID NO: 4683 - protein, 278 aa, Dermacoccus nishinomiyaensis
MRPEDFLTRVITDATPTAMDRSAAARNRAALNRWAETTFMGNYGFRETGSWSHGTAVRSMSDVDYFLSLRGARPSASKDTLESLRASLAIHLWNATVTINRPAVRAQFNDDSPDIEIVPAYLDLISDDYLIPDPVSTGWIRSNPRKHLAYVNSAHSQEPGAKQFIRLVKSWNHYQNVGLSSFYLEMRAAKHVLNNPPLLLLYDFCWLLNALHDGGLASMNDPSQFDGRRIEACPQVGRTDRARLVGIYTDAACKARELANDGSYGTAQVWLDFIFHPE

SEQ ID NO: 4684 - protein, 288 aa, Catenulispora acidiphila
MASDATEGFNTCLRWLTPSDAERSKASTHRAGIEAKLSSKFGLYRMFESGSFSNGTGVSGRSDTDLFASLKSSKPSLGSSSLSAVRYALLERFPSTSITVRTPAVVLNFGNGYERVEVIPAYAVGTTNGFTKYSIPGVTSDWMESTPQAHLAYVNGSNAKPSQGNAKALARLLKAWKYYQNVPISSFYLEMRAAAYTRTQSSIYYWMDIYFLLSSLQTTSLAAMNDPTGTTGSIRPCSSDATKQVALSKLDTAVTRAKKAFDAAKDGKMKVAFDNWDLLFGGNFPAYY

SEQ ID NO: 4685 - protein, 289 aa, Jatrophihabitans endophyticus
MARTAAEGFETFLGRLTPSESEREKASSHRASIYAKLDDRFGLYRMFESGSFKHGTGVSGKSDVDFFVSLKTSRPSLASSTLTSVKNALQDRFPSTYIHTSRPGVVLEFGGGYERVEVIPAYAQEKLSDGSMRFKIPGVTSEWLDSTPEAHFGYVNDSNSLPRRGAAKSLARLAKAWKYYRNVPISSFYLEMRAASYMRAQTYLDWPLDLYYFLNSLQSHELAAMNDPTGNTGRIEPCSSTTNKIDAKSKLDTAVNRALRAKDYYKDGRIRDAFDAWDLLFNGNFPAYY

SEQ ID NO: 4686 - protein, 289 aa, Amycolatopsis sp.
MAKTASEGFDTFLGWLTPTASERAKAASHRQSIKDKLESKFGVYRMFESGSFKHGTGVSGHSDVDYFVSLKSDRPVRSDSTLSAVRSALQDRFPFTRIHVERPAVVLEFGQGYERVEVIPAYAKERVTDKEVMKFNIPGVVDEWLESTPEAHASYVNDCNGTPKGGAKELARLVKAWKYYRNVPISSFYLEMRAAQYMEGETFLDYPQDIKRFLSRLQGHDLAAMNDPTGYTGRINACSTETKRNDALSKLNLAVTRATNALEEHKAGNTKKAFEWWDKLFNGEFPSYY

SEQ ID NO: 4687 - protein, 289 aa, Nocardia pneumoniae
MATDSTEAFENFLSWLVPTDANRAAAASHRSSLYSKLNSAYGLYRMFESGSFSHGTGVSGYSDVDYFVSLKTDRPAYSSSILTSVRDTLKERYPNTVIQVRRPAVVVNFGSGYETCEVIPAYAQGNVREGEMKFLIPGVTTEWLESTPESHLKYVNSCNAKPGEGYAKSFARLIKAWKYYRDVPISSFYLEMRAAKYISGQTTVVYAYDLAFFLEELSDGGLAAMNDPTGSTGRIEPCSSDAKRTEALSKLQTAATRARNALEANKKGDNRTAFYYWDQLFNGHFPAYY

SEQ ID NO: 4688 - protein, 289 aa, Lysinimicrobium soli
MAKTVPEAFATYLGWITPTDAARAKASAHRASIEAKLKSTFGVWRMYESGSWRHGTGVGGHSDVDYFISLRTDKPAYGSTVLGQVRAAMQERFPQTHVHVQRPAVVLEFGGGYERVELIPAFPEQKLASGAMLYAIPGVADEWMQSAPEAHLNYVDVANNRDEVKRGAKGLARLAKSWKYECNVPISSFYLEMRAAQYMNGERSVVWDMDLQRFLASLSSHDLADMNDPTGSSGRIKPCSSSATHRDALSKLRTAAVRADKAVAARESDPRAALGWWDYIFGGKFPGYY

SEQ ID NO: 4689 - protein, 294 aa, Pseudohongiella spirulinae
MPTRTVEQGFMAFHTKITPSGYQSGKATSHKSSITSRLEAYYDLNQLFYSGSANNGTNVSNLSDVDFFASIPTNKLKQNSTTSLREIKECLQDRFKSTPVYVDSPAVVLDFGSGDWDTAEVIPADFIGKTSKDKNIYDIPDGNGGWMKSSPSTHNAYVTYHNNRLGKKLKPLIRFMKAWKYYCEVPISSFYLELRVTKLMESESSIIYDIDLNSIFQKLKSSNLAAIQDPEGVSGLIYPCSSDARKMTALSKLNTAATRSQNARDSERSGSVREAFEWWDKVFAYNFPSYYYSN

SEQ ID NO: 4690 - protein, 292 aa, Vibrio breoganii
MPTRTINQGFNTFHSWITPSSYQSGKASSHKSSITSRLEAYYDLNQFFYSGSANNGTDVSDYSDVDFFASIPTKKLKQNSSTSLREIKECLQDRFTSTKVYVDSPAVVLDFGSGSWDTAEVIPADFVTKTSKGKNIYEIPDGNGGWMRSSPSTHNSYVTLHNNRLNKKLKPLIRFVKAWKYYCDVPISSFYLELRVTKLMETEESIVYEIDLNTIFQKLLTTNLAAIQDPEGVSGLIYPCKSDAAKSTALSKLSTAASRVKKAREAELAGNIREAFEWWDKVYAYRFPNYSY

SEQ ID NO: 4691 - protein, 290 aa, Geobacter pickeringii
MSRTVNRGFNELLHRVTPTHTEAESSKTLHLSLANLLRSGYGLNDFVITGSLHNGTCITGCSDYDYFAVIPTNRLKADSAATVSEIKNYLDFHLHHGEVSEQVPGVRVAFGVGAKDVTVVIPADMVAEANGCRVYEMPNPAGGWMRTSPEAHGAYLKTLEQRLGPGVRNLIRLMKAWKYSAGVSISSFYLELVTAKYLEGVSSVVYDVDMHGILSHLFNTEMAPIQDPTGVSGHVPPCTAHSDFVAVKEELTLAFIRANKALEARLHYNVAEAFDWWHLVYNGKFLKYFE

SEQ ID NO: 4692 - protein, 292 aa, Pedobacter jeongneungensis
MSRSISQGFDFLINSIKPLNSEHEKAASHKDSVKRCLENNFGCSYFFETGSFGNGTGVRHHSDTDYFARCPGGNFYLDSSKTLRIVKEALQRTFPRTPGIEVKSPAVRIPFGKYASERLELTPAYYNALIETPVGKRHAYNIPSHDGGWMKSSPTAHIAYVNREDLRLGGKLKPLIQLIKAWKFYNEIPIYSFYLELRVTKYAELENSIIFDIDIKNIIKFLYENDLPRIQDPMGISGYVNPCKSPAKKDIALSKLKTGYGRVIKAYNERDGNVDNAFYWWNLFYNGKFPSR

SEQ ID NO: 4693 - protein, 292 aa, Pedobacter rhizosphaerae
MARSLEEGFETFIGWLSPLLSEHQKATAHRESVKRCMENNFGCSSLIETGSFGNGTGVRHYSDTDYFARCPSDRLWADSAYTLRKVKEALQYTFSSTSNIMVKTPAVQIPFGLYKSETMEVTPAYYGGQVSTPFGDKYYYKIPDYTGGWMDSSPGAHIAYVNRENDRLSGKLKPLIQMIKAWKFYNAVPITSFYLELRVTKYAENEKVIVYDIDIKNIMKMLNDNQLAGLRDPMGISGNVPACKTLAKRLEALSKLNTAATRAIKAVENREKNITDAFYWWNLFFNGHFPSR

SEQ ID NO: 4694 - protein, 291 aa, Unknown
  Description of Unknown: uncultured bacterium sequence
MPRTIEEGFVDFNENLKLLKSESEAIKKHRASIHSCLKNKFGMNRFFKTGSVGNGTNVNGFSDTDYFAGIPTENLKENSASTLTAIKEALQETFPSTKNIRVDSPAVVVPFGTVASEITEIIPADFLKTEDGVNIYDIPDGDGKWMNASPKAHNEYVSKVDKKHGNKVKPLIRFIKAWKYYQNVPISSFYLEMRIAKYADQESIILYSTDVYYIFKNLLDGELSSMIDPVGVSGYIEACASQAKKDDAISKLKTALTRAEKARAAEEKGEIKESFEWWNLLYNEKFPSYYR

SEQ ID NO: 4695 - protein, 289 aa, Sediminibacter sp.
MPKTISQGFDILHTRLTPNTTESNAVKNHRASIKSCLENNFGMINFFKTGSNGIGTSIRGYSDTDYFASIPTKNLKENSATTLREIKEVLQKRFPTTGVYIDSPAVVCPFGTQNTETTEIVPADFIRLHNGNNIYDIPDGNSGWIKAGPKSHNQYVSEINKNLYFKVKPLIRFIKAWKYYCNVPISSFYLEMKIVQYAKDERYIEYSIDIMKIMASLLDNNLPALLDPTGISGYIYPCSTEAKKKDSLSKLATAKRRSANARTSEYNGNLEDAFYWWNLFFNEKYPSYY

SEQ ID NO: 4696 - protein, 312 aa, Ralstonia solanacearum
MDLKPAYQPSCCGGLSLPERKAVPRTIEQGFNDFLVNLRATAAETAATVSHRASIKACLENNFGLKRFTRIGSFGNGTNVSGYSDVDYLACLPTTSLKQSSTYSLRLVKEALENRFPSTGVVVRCPTVVCPFGQYKSQHTEVVVADYVKEQNGYKVYEIANGNDGWMQICPDAHNAYVEHVDGKHGGKVRQLIRLIKAWKFYQNVPIKSFYLEMKVAKYASNEQAIIHHLDVKYFLDRLNNEGLSAMQDPMGIAGYIYPCNSDVQKIDALSKLNTAATRANKAEAARALGNIKEAFDWWRLLYNDKFPTYYL

SEQ ID NO: 4697 - protein, 290 aa, Ralstonia solanacearum
MPRTIEQGFNDFLVNLRATAAETAATVSHRASIKACLENNFGLKRFTRIGSFGNGTNVSGYSDVDYLACLPTTSLKQSSTYSLRLVKEALENRFPSTGVVVRCPTVVCPFGQYKSQHTEVVVADYVKEQNGYKVYEIANGNDGWMQICPDAHNAYVEHVDGKHGGKVRQLIRLIKAWKFYQNVPIKSFYLEMKVAKYASNEQAIIHHLDVKYFLDRLNNEGLSAMQDPMGIAGYIYPCNSDVQKIDALSKLNTAATRANKAEAARALGNIKEAFDWWRLLYNDKFPTYYL

SEQ ID NO: 4698 - protein, 290 aa, Ralstonia solanacearum
MPRTIEQGFNDFLVNLRATAAETAATVSHRASIKACLENNFGLKRFTRIGSFGNGTNVSGYSDVDYLACLPTTSLKQSSTYSLRLVKEALENRFPNTGVVVRCPTVVCPFGQYKSQHTEVVVADYVKEQNGYKVYEIANGNDGWMQICPDAHNAYVEHVDGKHGGKVRQLIRLIKAWKFYQNVPIKSFYLEMKVAKYASNEQAIIHHLDVKYFLDRLNNEGLSAMQDPMGIAGYIYPCNSDVQKIDALSKLNTAATRANKAEAARALGNIKEAFDWWRLLYNDKFPTYYL

SEQ ID NO: 4699 - protein, 290 aa, Pseudomonas sp.
MPRTIEQGFIDFHNKIKTSVAETAAAKSHRSSIETCLKNNFGLNRFSRIGSFGNGTNISGYSDVDYLACLPRSVLTRTSTPSLVKVKNALQARFPTTGVTIDTPAVVCPFGQYKSEDSEIVVADYLKEEKGFKVYDIADSNNGWQQVSPDAHNYYVSEIDRKHDGKVKPLIRFIKAWKYYQGVPIKSFYLEMKVAKYASDEQVIIHNLDVKYFLERLSSDGLPAMQDPMGVAGYIYPCNSDVQKEDALSKLNTAATRARKADAAGSLGNVKEAFDWWRLLYDNKFPEYYL

SEQ ID NO: 4700 - protein, 290 aa, Pseudomonas sp.; identical to SEQ ID NO: 4699

SEQ ID NO: 4701 - protein, 290 aa, Burkholderia ubonensis
MPRTIEQGFIDFHNKIKTSAVETAAAKSHRASIEACLRNNFGLSRFTRIGSFGNGTNVSGYSDVDYLACLPRSVLTRTSTASLVKVRNVLDVRFPNTGVKVSTPAVVCPFGTYKSEDTEIVVADYLREEKGFKVYDIADGSDGWMEVSPDAHNYYVSEVDRKHGGKVKPLIRFIKAWKYYQNVPIKSFYLEMKVAKYASDEKAIIHYLDVKYFLDRLNNEGLSAMQDPMGVAGYIYPCNSDAQKTDALSRLNTAATRANKAEAARAAGKVSEAFDWWRLLYNDKFPSYYL

SEQ ID NO: 4702 - protein, 290 aa, Burkholderia sp.
MPRTIEQGFIDFHNKIKTSAVETAAAKSHRASIETCLRNNFGLNRFTRIGSFGNGTNVSGYSDVDYLACLPRSVLTRTSTASLVKVKNVLDVRFPNTGVKVSTPAVVCPFGTYKSEDTEIVVADYLREEKGFKVYDIADGDDGWMEASPDAHNHYVAEVDRKHGGKVKPLIRFIKAWKYYQNVPIKSFYLEMRVAKYANDEQTIIHHLDVKYFLDRLNNEGLLAMQDPMGVAGYIYPCKSDVQKTDALSRLNTAATRANKAEAARAAGNVSEAFDWWRLLYNDKFPTYYL

SEQ ID NO: 4703 - protein, 290 aa, Magnetospirillum caucaseum
MPRTIEQGFSDFHDKIKTSATETAAAKSHRASIEACLKSNFGLNRFARIGSFGNGTNINSYSDVDYLACLPTSVLTKTSTASLVKVKNALDTRFPNTGVKVSAPAVVCPFGTYRSEDTEVVVADYTKEENGFKIYEIADGNGGWMEVSPDAHNHYVAEVDKKHGGKVKPLIRFIKAWKYYRDVPINSFYLEMRVAKYANGESSIVYDIDVKQILTMLSGNELAAMQDPMGVSGYIYPCKTDAFKQDALSKLKTAATRAEKARVAEANNDTKTAFDSWRLLYNDKFPAYYL

SEQ ID NO: 4704 - protein, 288 aa, Photobacterium angustum
MPRNINKGFDDFHNKIRTSAVETLAAKSHRASIESCLKRNFGLNRFTRIGSFGNGTNISGYSDVDYLACLPRNVLTNTSTTSLTKVRNALNIRFSSTNVKISTPAVVCPFGTRKSEDTEIVVADYIKEKNGFKVYEISDCNDGWMEVSPDAHNDYVAKVDKKHDGKVKPLIRFIKAWKYYANVPISSFYLEMKVAKYANSESSIVYDIDVKLILKMLMSDELSRMQDPTGVSGYISPCKTEILKRDALSKLSTATIRADKARIAESNDDTETAFYWWNLLYNNNFPNY

SEQ ID NO: 4705 - protein, 288 aa, Photobacterium angustum; identical to SEQ ID NO: 4704

SEQ ID NO: 4706 - protein, 290 aa, Chromobacterium piscinae
MPRTIEQGFKDFHDNIKATAAETDATVSHRASIKACLENNFGLKRFTRIGSFGNGTNVSGYSDVDYLACLPTTSLKQSSAYTLSLVRDALDRRFPSTGVKVSTPAVVCPFGKFKSQHTEVVVADYVKDNSGYKIYEIADGSGGWMQICPDAHNAYVDVVDKKHGGKVKPLIRFIKAWKCYRDVPIKSFYLEMRVAKYADGETSIVYDIDVERILTMLRYNGLAALQDPMGFAGYIHPCKTEAFKQDALSKLNTAATRAEKAREATTNGDIKEAFDWWRLLYNDKFPTYYL

SEQ ID NO: 4707 - protein, 290 aa, Yersinia pseudotuberculosis
MPRTIDQGFCDFHDKLKTSVAESIAAKSHRASIEACLINNFGLNRFVRIGSFGNGTNISGYSDVDYLACIPTTQLTVNSSTSLSKVRNALSTRFPNTGVRVSCPAVVCPFGTYRSEDTEVVVADYIHENDGFKVYEIADGNDAWMRISPDAHNAYVREVDNKHGGKVKKLIRFIKAWKYYQNVPIKSFYLEMRVAKYADQETSIVFDIDVKRVLCMLLDSNLAAMQDPMGVAGYIYPCQTSHQKDDAISKLTTAVKRAEKARDAANIGEIKEAFNWWGLIFNDKFPDYYL

SEQ ID NO: 4708 - protein, 290 aa, Citrobacter freundii
MPRTIDQGFCDFHDKLKTSVAESIAAKSHRASIEACLKNNFGLNRFVRIGSFGNGTNISGYSDVDYLACIPTTQLTVNSSTSLSKVRNALSTRFPNTGVRVSCPAVVCPFGTYRSEDTEVVVADYIHENNGFKVYEIADGNDAWMRISPDAHNTYVREVDHKHGGKVKKLIRFIKAWKYYQNVPIKSFYLEMRVAKYAEQETSIVFDIDVKRVFSMLLDSNLAAMQDPMGVAGYIYPCQTNHQKNDAISKLTTAVNRAEKARDAASRNEIKDAFYWWGLIYNDKFPSYYL

SEQ ID NO: 4709 - protein, 290 aa, Methylomonas sp.
MPRTVDEGFRDFLKKLTPSSVETDAAKRHRASIEACLKSNFGMNRFIRIGSFGNGTSISGYSDVDYLASLPADRLYRSSSYSLTKVRDVLNARFPNTGVRVSCPAVTVPFGTKKSEAHEIVPAYYVKDNNEFKIYGIADCADSWMNACPDAHNAYVKSVDEKFNGKVKPLIRFIKAWKYYQNVPISSFYLELRVAKYASGESSIIYEHDVKRVLCWLRDNNLPKIQDPMGISGYIYPCKSDTAYNDAMSKLRTAATRSEKARESADKGNISDAFYWWNLLYNDQFPSYYY

SEQ ID NO: 4710 - protein, 290 aa, Delftia sp.
MPRSTEEGFADFLAKLKATAPEVEAAKRHRASIEACLRNNFGLLRFTRIGSFGNGTSVSGYSDVDYLASIPTSMLTASSTYSLMKVRDALDARFPSTGVRVNSPAVSVPFGKYRSEDTEVVPADYIEEVNGFKIYEIADGNGDWMRISPDSHNAYVARVDAALSGRLKPLIRFIKGWKFLCNVPISSFYLEMRVAKYAEGESTIIYDIDIKRVLRSLWDCQLARMQDPTGFSGYISACKTKAQEQDALSRLSTAVVRAEKAYNARANGAIADAFDWWRLVYADAFPTYYY

SEQ ID NO: 4711 - protein, 290 aa, Hydrogenophaga flava
MPRSIEDGFQDFLIKLKAKAPETEAATRHRASIQQCLIGNFGLTRFVRIGSFGNGTSVSGFSDIDYLASIPTARLTQSSTYSLSKIRDALDTRFPKTGVRVNTPAVAVPFGTYRSESTEVVPADYIGESNGHKVYEIADGGGGWMRISPDSHNDYVARIDRRLDGKVKPLIRFIKAWKFHRSVPLSSFYLEMRVAKYAESEPSIVYDIDVARVLKSLWDHQLAKLQEPTGFSGFVAACKSEAQREDALSKLSTAVMRAQKARKASIDGATSDAFYWWRLLYNEAFPNYYC

SEQ ID NO: 4712 - protein, 289 aa, Rhodanobacter sp.
MPRSIEQGFSDFLEKLKAKIPESQAATNHRASIEACLRSNFGLNRFVRIGSFGNGTSVSGYSDVDYLASIPANEVTASSSYFLTKVRNALDTRFPLTGVRIDTPAVVVPFGTYKSETTEVVPAGYVTQNTYKVYKIADGDGGWMNISPDAHNDYVSTIDTKLGGKVRPLIRFIKAWKFYRGVPISSFYLEMFTARYASTETSIVYSIDIKRVLRQLVDRELPNMYDPTGVGGTIKPCKTALSHADALSKTGTASTRAGKAYDAELRGDTKGAFDWWSLLYDGHFPTYYL

SEQ ID NO: 4713 - protein, 291 aa, Vibrio anguillarum
MPKTLDQGFRDFVTKLTPTSSETAAAKSHRASIKSVLDTHFKMTNFFRTGSFGNGTSISGYSDVDYFAVFPSPQLNVNSATSLVNVRERLAARFPNTGVRVSCPTVLVPFGTSKSEWTEVAPCDHVSTNDNGFKVYEIANGSGGWLKSSPASHNSYVKRIDDKHNGKVKELIRFIKAWKYYNDVPISSFYLELQTARYCDSESTIVHRFDIKGVFNVLLSNELASMQDPMKVSGLISACGSDVQKDSALSKLRTAYTRASKALTAEEAGKTKEAFDWYNLLYNDKFPNYYL

SEQ ID NO: 4714 - protein, 288 aa, Candidatus Thiomargarita nelsonii
MPRTINKGFTNFLSKLTPTSVESKTAKNHRASIKACLKSNFNFREFFRSGSFGNGTSISGHSDVDYFVCIPNFSPNSRTFLLTQVRNALDGRFPRTRVRVSCPAVKVPFGTEAKESTEVVPALIDTSKSGYRTYNIPDCYGGWMRSSPDAHNEYVRKIDNKLNGKVKPLVRFIKAWKYYRQVPISSFYLELRVARYAEQKSSIVYDKDIKRIFNFLSDNQLAKMQDPMGISGYIHPCSTPAKLKEAKSKLATALSRATKAVAARENDVKNAFDWWKLLYNNNFPSYYK

SEQ ID NO: 4715 - protein, 298 aa, Poribacteria bacterium
MRTRTIEQGFKKFLRALKPTSKESDAAKSHRASIEACLKSKFGITRFVRTGSFGRGGTSISGYSDVDYFAQIPTSNLEKNSTFMLRRIRDVLDKRFPRTGVRVSRPAVIVPFRPDGKERTEITPAGYVEVTTKDEYKVYDIPDFSGGWVRSSPDAHKAYVRKIDQKLNGKVKPFIRFVKAWKFYQKVPISSFYLELRTAKYIGSKPSIAYDDYDVAVKRIFSHLLHDVKLAKMRDPIGICGQIKPCSTDKKLENTKSRLSTALTRSQKACDARKNGDIENAFYWWNKLYNRKFPGYYY

SEQ ID NO: 4716 - protein, 292 aa, Ignavibacteria bacterium
MSKRTLTEGFDDFLDRITPSSFETDAAKSHRASIEKCLKDNFGMKNFFRTGSFGNGTNISRFSDVDYFAVIPAVNLKKESSKSLSAIRDVLNTRFFSTNVRVNCPAVSLPFGTDAKEMTEVVPSYYIKDDYRGYQIYGIPDCNNGWMNASPVAHNAYVREKDNKLSNKLKQLIRLLKAWKYYCNVPILSFYLELRTTKCCETMDGIVYIYDIKHVFKYLYDCELSQMQDPMGISGYINPCRSDNQIEESMSKLSTALTRSEYALDAFNKNDIEKTFNYLDKIFDGNFPSYYK

SEQ ID NO: 4717 - protein, 289 aa, Mesorhizobium sp.
MAKDVNDAFGILIDRLKPSEVETISAASHRASIDACLKEKFKMTSLFRSGSFGHGTSVKGYSDVDYFAVIPAANLWTSSNYSLIKVKEALQARFPLTSIAIRSPVVIVPFGGGAGGEHHEISPAYANGTNNGHTVYAIPNRTDGWMSSSPNAHNAWVNVINDKHSKKVKQLIRLLKYWNYVQSAGIRSFYLELRTAEYANYETAILYNIDVKRMFAVLINKGLAAMQDPQGVSGYVYPCSDAVKESALSKLRTALTRAEKAYEAENAGKYSEAFQWWDMVFGGKFPAYY

SEQ ID NO: 4718 - protein, 246 aa, Agrobacterium genomosp. 9
MTNFFRSGSFGHGTSIRTVSDVDYMAVIPPGNLADNSSTALENVKSALVKRFPNTNVHIRNPAVVIPFGTGPAERHEVTPGYYLENADGYNVYGISNRAGSWMRTSPTAHGAWINDINDNLSKKLKPLIRFMKLWNFKRSGGIRSFYLELRTGEYARGESTIVYSIDMLASLRHLRNKGLAQMQDPMGISGYIPACSDAVKQDALSKIDTAISRAEKARDAEKEGRISQAFDYWKLVFDGYFPNYG

SEQ ID NO: 4719 - protein, 246 aa, Sinorhizobium fredii
MTNFFRSGSFGHGTSISGYSDVDYMAVLPRSKLSSNSSTTLQKVRDALAYRFPRTAVSIRSPAVVVPFGNKISERHEITPADYMGKTNGSSVYEIPNRYGEWMTTSPHAHGEWINSINLRNPGTKALIRFIKLWNYKREAGIRSFYLEMRVAQYAASESYISYPVDVWRALNFLRNKELAAMKDPTGLCGSFYPCSDAMKSQALSKLDTAIARAERAYKNDQAGNVFNAFEDYGLLFNGYFPSWGY

SEQ ID NO: 4720 - protein, 289 aa, Limimonas halophila
MTVTVEQGFKQFHKRLQPSQTAQRGAQQHRRSIQACLEANFGLNAFRRTGSFGNGTSVANCSDVDYVAGLPPGSYQKDSDRTLKQLRDALARTFPRTGVKRSCPAVVAPFGQRKEEDTEVVPAKYIGQRNGRFDVFAIPNCSGGWMPTSPDAHNAYVIEVNRQRGQKVKPLIRFIKAWKYARQVPISSFYIELFVARQAATQNGILYSRDVVGVFNAMERTDLTRISDPMGVSGNVQPCRTRSRLNTARSRVRSTAKKARQAWQAECNGQKRRAFILWNEVFSGGFPSP

SEQ ID NO: 4721 - protein, 280 aa, Nocardia alba
MDRYVGQLVNQTPDQQLVAQRRADINRLLKAAGILSTFESGSFNHGTAIPKHSDVDLMARIPYSWRALAPYSALVKTRDALATESYRFSSLKISSPAVKVQYSYGPSFEVAPAYFDRLTPGGDDVFEIPAPGEWVASAPSAHNRYVSRQNDRLGKRVKPLVRLLKAWKYHADVPVSSTYLELRTAEHAAGESSIHYQIDMSSILRKIVVADFREMNDPIGIVTRIRPCSSEDNRRKALAAAKSAKDYLAIAREAKDRSDTSSYWKAMYSIFGYDFPYPRW

SEQ ID NO: 4722 - protein, 294 aa, Microbispora sp.
MTALWEAIDQYLADRAPKDWEKAEVRRYRQRIHEILNSEFRLMSFFQSGSFQHGTAVTPHSDVDYMVRIHFEDKPNSSNTILDKMRDVLKRELWEANKVFVARPTVTLQFTGFVTNYEITPAYLLRGDSDENRVVLIPDSGGEWREAAPQAHNKFVAEMDRKHTGDVRKIARLLKAWKYEHAVPISSFYLEMRCAEYGKNNANIWALSTLRTIVGSMISNGLAAMNDPTKLVSRITACSGESNRLTAITRLRALKKHLDAAYGAWLAGESKRWEMNQALRAVWGTGFPYCDPRS

SEQ ID NO: 4723 - protein, 298 aa, Rhizobium sp.
MCEIKQSIGKLMIKTIRDAFWQFKANLEITSLQETTTSTRQQSVRSAVENDFAVLDSFLTGSYRRNTMIAPLSAADIDVFIVLDPKYYAASNQLSLLSAVMRALKREYPKTPKIKPDGQAVTITFADFKVDVVPGFYRTDGGFLIPDGNLSRWIATDPKKHVELWSASNKVHSGSLVPLIKMLKCWNRNNGDLFRSFHLEVLVRNVLTGVTISDYPSGARWVFDKMRAQVWTKVADPAGYSDDVAAYLQKAHADKMIAALDKAFHRAAVAETNAQQGFVKAAIDGWRGIFGDYFPPYN

SEQ ID NO: 4724 - protein, 287 aa, Rhizobium sp.
MIKTIRDAFWQFKANLEITSLQETTTSTRQQSVRSAVENDFAVLDSFLTGSYRRNTMIAPLSAADIDVFIVLDPKYYAASNQLSLLSAVMRALKREYPKTPKIKPDGQAVTITFADFKVDVVPGFYRTDGGFLIPDGNLSRWIATDPKKHVELWSASNKVHSGSLVPLIKMLKCWNRNNGDLFRSFHLEVLVRNVLTGVTISDYPSGARWVFDKMRAQVWTKVADPAGYSDDVAAYLQKAHADKMIAALDKAFHRAAVAETNAQQGFVKAAIDGWRGIFGDYFPPYN

SEQ ID NO: 4725 - protein, 287 aa, Mesorhizobium ciceri
MVTTISEGFRQFRTNLEITSLQESTTSSRQQNVRDTVAEDFEVLESFLTGSYRRNTMIAPLTTADIDVFIVLDPKYYTDQSQHALLSSVMTTLKKRYPKTPKIKPDGQAVTITFTDFKVDVVPGFYRTGGGFLIPDSHLKRWIPTDPKKHVDLWSASNKAHHGSLVPLIKMLKCWNREKGNLFRSFHLEVLVRHVLKDVTITDYPSGARWVFDKMRDKVWTKIADPAGYSDDVASYLAKSEADRMIAALDQAYRRARTAENYSNQGYAKLAIDEWRSIFADYFPAYG

SEQ ID NO: 4726 - protein, 287 aa, Mesorhizobium temperatum
MVTTISEAFRQFRTNLEITTLQESTTATRQQNVRDAVAEDFEILESFLTGSYRRNTMIAPLTTADIDIFIVLDPKYYADQNQHALLSFVMKTLRKRYPTTPKIKPDGQAVTITFTDFKVDVVPGFYRTGGGFLIPDANLKRWISTDPKKHVDLWSASNKAHNGSLVPLIKMLKCWNRRKGVLFRSFHLEVLVRHVLKDVTITDYPSGARWVFDKMRDKVWKKIADPAGYSDDVASYLAKSEADRMIAALDQAYRRALTAENYANQGYAKLAIDEWRLIFADYFPAYG

SEQ ID NO: 4727 - protein, 287 aa, Rhizobium sp.
MATTIAGAFQQFKANLEISSLQESTTSTRQQNVREALSRDFAVLDTFLTGSYRRNTMIAPLKSADIDVFAVLDPKYYAAQNQHSLLTSVMTTLKKKYPSTPRIKPDGQAVTITFTDFEVDVVPGFYRNGGGFLIPDANLRRWIPTDPKKHVELWSQSNKAHNGALVPLIKMLKCWNRSNGNLFRSFHLEVLVRHVLQEVTISDYASAARWVFDKMRGNIWVKVADPAGYSDDVASYLAKSEAAKIVAALDNAYRKAVAAESNASYGFVRSAIEDWRTIFGDYFPGHG

SEQ ID NO: 4728 - protein, 289 aa, Devosia sp.
MAMAKTIADAFRTLRSNLEITDLQEQIVSGRQQAIRGVLERDFAVKDSFLTGSYRRSTMIGPLKEADVDIFVVLDVKYYRQDGKKALLESVKKSLRKTYTLTPDIRPDGSAVTITFSDFKVDVVPSFVRKGGGYLIPSLELNKWISTDPKKHVELWSTSNKAHNGDLVPLIKMLKGWNKSRSLLKSFHLETLIWTALNGVTITDYPSGMWFVFDKAIALVQRQLADPAGYCADVGEHVDTQAKIKALVDRLTWARDRSLEAIQLANAGNVPAAIEKWRLIIPNYFPAYG

SEQ ID NO: 4729 - protein, 287 aa, Devosia sp.
MAKTIADAFRTLRSNLEITDLQEQIVSGRQQAIRGVLERDFAVKDSFLTGSYRRSTMIGPLKEADVDIFVVLDVKYYRQDGKKALLESVKKSLRKTYTLTPDIRPDGSAVTITFSDFKVDVVPSFVRKGGGYLIPSLELNKWISTDPKKHVELWSTSNKAHNGDLVPLIKMLKGWNKSRSLLKSFHLETLIWTALNGVTITDYPSGMWFVFDKAIALVQRQLADPAGYCADVGEHVDTQAKIKALVDRLTWARDRSLEAIQLANAGNVPAAIEKWRLIIPNYFPAYG

SEQ ID NO: 4730 - protein, 287 aa, Sinorhizobium meliloti
MVRTIADAFRVLRSNLEITDLQEQTVASRQKAIREVLARDFIIKDTFLTGSYRRSTMIRPLKEADVDIFIVLDLKYYRDDGKRTLLESIKKSLRKTYTKTPDIRPDGSAVTVTFTDFKVYVVPAFYRQGGGYLIPSLELNKWISTDPKKHVEIWTAANKAHNDDLVPLIKMIKGWNKSRNLFKSFHLETLILKALDGVTITDYPSGMRYVFDKGITLVQYKLADPAGYSGDVGAHVETKAKIQLLVDRLIWARDRAKEAEAMAADGNVANAIDKWRLIVPSYFPRFG

SEQ ID NO: 4731 - protein, 287 aa, Pelagibacterium luteolum
MVRTIADAFRVLRSNLEITDLQEQTVAGRQKAIREVLERDFDIKETFLTGSYRRSTMIRPLKEADVDIFIVLDVKYYREDGKKALLESIKKSLRKTYTKTPDIRPDGSAVTITFTDFNVDVVPAFYRKGGGYLIPSLELNKWISTDPKKHVEIWTAANKAHNNDLVPLIKMIKGWNKSRGLFKSFHLEALILKALDGITITDYPSGMRYVFDKGIKLVQYKLADPAGYSDDVGAHVDTKVKIQLLVDRLTWARDRAKEAEAMTAGGNVAGAIEKWGLILPSYFPRYG

SEQ ID NO: 4732 - protein, 293 aa, Cohaesibacter sp.
MVKTIAEAFRVFRSNLEITDLQEQAVASRQRDIRGVLDRDFVINDTFLTGSYRRRTMIRPLKEADVDIFIVFDVKYFHSGGKKALLESIKKSLRKTYSKTPDIRPDGSAVTITFTDFKVDVVPAFNRNGGGYIIPSLELNKWIPTDPRKHVELWTAANKAHNCDLVPLIKMIKGWNKSRNLFKSFHLETLILKALDGVTITDYPSGMRYVFNKGISLVQYELADPAGYSDDVGAHVNTEAKIKLLVDRLTWARDRSREAEAMAKAGNVSGAIDKWRLIVPNYFPAYGGLDSPR

SEQ ID NO: 4733 - protein, 250 aa, Caulobacterales bacterium
DAGLTVLDTFLTGSYQRSTMIAPLSEADIDIFAILDPKHYAANGQAGLLNTVRSVLRKTYTQTPDIRPDGQAVTIRFSDFKVDVVSGFYRTGGGYLIPDSQLGRWISTDPKAHVDLWADSNKAHQGDLVPLLKMLKAWNQSRNVLRSFHLETLARDVLRGVTITDFPSGLRYIFDKARAKIHSKLADPAGYSDDVAAYLNTEAAMDNVVKRLDWAFQQARDAEADDAAGRTAKAFERWRLLLPNSFPAYG

SEQ ID NO: 4734 - protein, 287 aa, Novosphingobium sp.
MARTIDEAFRVLRTNLEITDLQEKTVSTRQTSIRSVLESDFIVLDSFLAGSYRRSTMISPLKEADVDIFVILDPKYYAAQGQTGLLNAVRASLLKTYTKTPKIRPDGHAVTITFTDFKVDVVPGFHRKGGGYLIPDTSGPRWIPTDPKRHVEIWSQANRTHNGDLVPLLKMLKGWNASRSLLKSFHLETLALDILTNVTISSFPSGIRYFFDKARAKIRTKLADPAGYSDDVAQHVNTTEQMDTIVKRLDWALARAQEAEKFAAAGRTMDAFAKWSQLIPNHFPAYG

SEQ ID NO: 4735 - protein, 293 aa, Candidatus Roizmanbacteria bacterium
MAKTINASFEQFKQNLNITGLQQSIVSTRQTNIREVVENDLLVSDSFLTGSYSRSTMIAPLSEADIDIFIVLDSKYYHNYNGQNGGQAGLLDLVKRTLKKTYTKTPDISRSGQAVTIRFDDFVVDVVPGFNRQGGGYLIPNSITQSWISTDPKKHVEISSQANTAHDGDYIPLVKMIKSWNKKHSSFFRSFHLEVLALKIFNNVAISDFPSGVRFYFEKGLSLISQKNTDPAGYGGDIGNYLNSKEIIDDGVSRFQKAYEIATKAEQYGNDGYIELAVNKWRVLFGDYFPSYG

SEQ ID NO: 4736 - protein, 294 aa, Ignavibacteria bacterium
MATTITASFQKLKENLEITGLQASTVSTRQNNVRDVIKKDLSVLDSFLTGSYSRSTLIAPLKEADIDVFVVLDSKYFHHYNNGQNGGQAGLLDLLKRTLRKTYTETPDISRNGQAVTIRFTDFMVDVVPAFNRQGGGYLIPNSVSQSWISTDPKKHVEIVANSNKAHNSDFVPLVKMIKAWNKNNNKYFSSFHLEVLALSILNNVTISDYPSGIRFFFDKARDLITKQNPDPAGYGGDVGNYINTQEKIKEAVTKFELAYNRAIKAEDFGNRGYTKDAVDLWIKIFGDNFPTYG

SEQ ID NO: 4737 - protein, 295 aa, Candidatus Vogelbacteria bacterium
MATTIPQSFLKFKQNLEITDYQEATISTRQKSVRGVIEAGMTLIDPYSFLTGSYSRQTLIAPLKEADIDIFFVLDPKYYQNYNGQNGNQAGLLDLVKRTLLKTYTKTPDISRNGQAVTIRFDDFVVDVVPGFKRQGGGFLIPNSVNQSWISTDPKKHVEIMSAANKTHNSDLIPLIKMIKAWNKNNSKYFSSFHLEVIALEALNNVTITDFSSGARYFFDKGRTLVAQKNLDPAGYGGDVGSYINTQEKIQEAVAKFQLAYDRAIKAEDYATRGYVKDAVDMWIKIFGNYFPTYG

SEQ ID NO: 4738 - protein, 293 aa, Unknown
  Description of Unknown: Microgenomates group bacterium sequence
MATTINQAFAQFKTNLNITDLQEQTVSTRQQNVRKVIEDGLTVLDSFLTGSYSRNTMISPLSEADIDIFMVLDNSYYYHYDGKNGAQAGLLDFVKRTLRKTYTKTPDISRNGQAVTIRFDDFMVDVIPAFNRQGGGYLIPNSITQSWLSTNPKKHVELTSSANSSHNGDFVPLVKMIKCWNRNIQSHFHSFHLEVLALSIFSNVEISDSPSGVRYFFDKARDLVTKKNSDPAGYGGDIGNYINNQDKIDEAVSRFQTAYDRAVKAEYYLTLGQTSNAIDEWRKIFGSYFPTYG

SEQ ID NO: 4739 - protein, 287 aa, Candidatus Moranbacteria bacterium
MAITITSSFQKLKENLEITGLQKSTASTRQENVRDVVSNDMDVLDSFLTGSYARSTMIAPLSEADIDIFIVLDPKYYESDGQASLLDKVKRALLKTYTKTPKISRNGQAVTITFTDFVVDVVPAFNRKGGGYLIPNSVQKTWIATNPKTHVDVMVQENKNHNGDLVPIVKMIKGWNKNINNDFVSFYLELLAIKIFKNVTISDFSSGMRFFFDKGREGIKSKVHDPVEYGGQINGLRNCKTVEATVGRFETAYNRAIKAEQYAKNGNIENAVDEWKKVFGDYFPAYG

SEQ ID NO: 4740 - protein, 295 aa, Rhizobium sp.
MKATMATTIQQGFAQLKANLEITGLQGGTVSSRQTRVRSVIEAGMNVHDSFLTGSYARHTMIAPLNEADIDIFFVLASSYYHQYSPNGPAGLLDAVRRTLLKTYTSTPSISRNGQAVTIRFTDFVVDVVVGFNRQGGGYIIPNSVTSKWLSTDPKRHVEIVSAANKDHGGLLVPIIKMLKAWNKGSGSFFRSFHLEVLALTVFDGVTISDFPSGVRFFFDKVRPLIRQGIKDPAGYGDNVGGYLSTQSKIDEAVTRIQAALNIALAAEQHNFANRNRAATEQWQRLFPDYFPAYG

SEQ ID NO: 4741 - protein, 291 aa, Rhizobium sp.
MATTIQQGFAQLKANLEITGLQGGTVSSRQTRVRSVIEAGMNVHDSFLTGSYARHTMIAPLNEADIDIFFVLASSYYHQYSPNGPAGLLDAVRRTLLKTYTSTPSISRNGQAVTIRFTDFVVDVVVGFNRQGGGYIIPNSVTSKWLSTDPKRHVEIVSAANKDHGGLLVPIIKMLKAWNKGSGSFFRSFHLEVLALTVFDGVTISDFPSGVRFFFDKVRPLIRQGIKDPAGYGDNVGGYLSTQSKIDEAVTRIQAALNIALAAEQHNFANRNRAATEQWQRLFPDYFPAYG

SEQ ID NO: 4742 - protein, 292 aa, Bradyrhizobium erythrophlei
MPYTVADSFTKLRSNLEITFDQALTVSTRQNGVRDTVNAGMKVVDDFLTGSYMRSTMISPLKEADVDVFVVLDPHYFHHYNNQNGGPSGLLDYTKRLLLKTYTSTPDISRNGQAVTIRFSDFVVDVVVGFNRTGGGYLIANAVGNFWLETDPKKHVALMTEANKYHKGNLVPLIKMIKSWNKAHGAFFRSFHLEVLAFEAFRNVTISDFPSGLRFFFDKAQALVRGRNLDPAGYGDDIGRYITQSTVEEASRKLQGAFNTAVNAEMYGDRGDPRNAIITWKALMPYHFPAYG

SEQ ID NO: 4743 - protein, 287 aa, Mycobacterium malmesburyense
MATSIQSSFLVFKSNLEITGLQQSTVSARQQSVRAAVARSLTVTNSFVTGSYSRHTMISPLNSADIDIFVVLDAAYFDSNGYATVLDHVRRVLLETYPTTPKISRNGQAVTITFTDFVVDVVPAFNRSGGGYLIPSTTERRWIPTNPKQHEIFMSNANHTHDGDLVPVVKMIKAWNRQIGDAFRSFYLELLVERALRNVRITDFPSGCRFVFDKGRELIKYTISDPAGLGSNVHGLAGANNVSEAVSRFETAYNRAVLAEAYANQGRVADAVAEWRKVFGNYFPAYG

SEQ ID NO: 4744 - protein, 287 aa, Verrucomicrobia bacterium
MPTTILQGFAKFSSNLEITGLQAQTVSTRQQNVRDTVAAGFTVLDSFLTGSYKRSTMIAPLSQADVDLFVVLDSSYFTKFTQKDLLEEVRTALRKEYPTTPRFSKNGQAVTITFSDFQVDVVPAFYRQGGGYLIPNANSNQWISTDPTKHEAIWTEQNKWHQGDLVPFIKMIKCWNREHSGFLRSFHLETVVLETLRNVTMNDWPSAVRYFFDKARTTAWSPINDPAGYSGDLTGYLFYTDKVEVQKRAQAAYDRALQAEGYIKDCYIADAYGRYRIIFGDYFPAYG

SEQ ID NO: 4745 - protein, 291 aa, Candidatus Woesebacteria bacterium
MTITEAFNQYASNLNISERQENKVSNCRTNVVREIGEKLRLHSERSKVIGSWDRNTLIRYLSEGDVDIMIILHYGDNKDWDTPAGTISALDTFKKVLDDAYSNTVKRRDVNCITMQLSEFRLDIVPAFKLDTGRYKIPDSIKQRWIETDPFSFAKLITDVNKTMGNSFVPLIKMVKGWNREVGSPIKSFHLECILYNRYKTYEKGYSYDSMLKYFFQDLASYLNIPCYDPITGERVDSYLDNSTTPTKREIAINKASMAAKKSLEAYNDQEKYPTLAHNAWKELLGEFFPA

SEQ ID NO: 4746 - protein, 338 aa, Candidatus Peregrinibacteria bacterium
MTTLHTLIEFEQKAPLGAFLLHLERECSLCTTLHTFYDKMGLMATTVKESFRQYAQNLNITDKQETKVSNCKNNVTDVISKKLSLHSDGGRVIGSWDRDTMIRYLSEGDVDLMVVLHHGDNKDWDNNSGPDKALDKFKSILDDKYSDTTIRKDRNCVSMQLSEFTLDVVPAFKYDTGNYRIPDTYRGVWVSTNPIEFAKKITAVNKTMDGCFVPLIKMVKGWNRERGWPIRSFHLETMIYEHYKNYEKAYTYDSTLKVFFNDLPGYLRSPCYDPVTSDRLDGYLDNGTNPTKRTEAIEKAERAASKTSEAMEYTEAGKEQKAIEIWESLLGEFFPAYG

SEQ ID NO: 4747 - protein, 336 aa, Acinetobacter baumannii
MATTVISAFNDFQKNIVNLDSATSSTARNSRNWLLDQISNFPENNDNFPNLYPEIDIGFGSFARKTKTRPLDDIDLMVGIKADGCTYYERSWDDIELKFPENYSGKLKKYAKTLDSSGLSSTRITNAFKSELSKVSQYSSAEIKRDGEAATLKLKSYTWNFDIVPCFLTSPDSDGNSYYLIPNRSGNWKKTNPKTDRDRLSAVNQNQSGNVLNVIRILKYWKQEKRVNIGSYLLEAMILYYYESKPNNTCSEYVDLELENVFNYLANSIINTVADPKNIQSNINDIDYYSRYSLSEKFKTFAQLSRDARQLENEGKDKESINTWKKVFGYNFPDYG

SEQ ID NO: 4748 - protein, 336 aa, Unknown
  Description of Unknown: Acinetobacter sequence
MATTVISAFNDFQKNIVNLDSATSSTARNSRNWLLDQISNFPENNDNFPNLYPEIDIGFGSFARKTKTRPLDDIDLMVGIKADGCTYYERSWDDIELKFPENYSGKLKKYAKTLDSSGLSSTRITNAFKSELSKVSQYSSAEIKRDGEAATLKLKSYTWNFDIVPCFLTSPDSDGNSYYLIPNRSGSWKKTNPKTDRDRLSAVNQNQSGNVLNVIRILKYWKQEKRVNIGSYLLEAMILYYYESKPNNTCSEYVDLELENVFNYLANSIINTVADPKNIQSNINDIDYYSRYSLSEKFKTFAQLSRDARQLENEGKDKESINTWKKVFGYNFPDYG

SEQ ID NO: 4749 - protein, 336 aa, Acinetobacter ursingii
MATTVISAFNDFQKNIVNLDSATSSTARNSRNWLLYQISNFPENNDNFPNLYPEIDIGFGSFARKTKTRPLDDIDLMVGIKADGCTYYERSWDDIELKFPENYSGKLKKYAKTLDSSGLSSTRITNAFKSELSKVSQYSSAEIKRDGEAATLKLKSYTWNFDIVPCFLTSPDSDGNSYYLIPNRSGSWKKTNPKTDRDRLSAVNQNQSGNVLNVIRILKYWKQEKRVNIGSYLLEAMILYYYESKPNNTCSEYVDLELENVFNYLANSIINTVADPKNIQSNINDIDYYSRYSLSEKFKTFAQLSRDARQLENEGKDKESINTWKKVFGYNFPDYG

SEQ ID NO: 4750 - protein, 336 aa, Acinetobacter venetianus
MATTVISAFNDFQKNIVNLDSTTSSTARSSRNWLLDQISKFPENNDNFPNLYPEIDIGFGSFARKTKTRPLDDIDLMVGIKADGCTYYERSWDDIELKFPENYSGKLKKYAKTLDSSALSSTRITNAFKSELSKVSQYSSAEIKRDGEAATLKLKSYTWNFDIVPCFLTSPDSDGNSYYLIPNRSGSWKKTNPKTDRDRLSAVNQNQSGNVLNVIRILKYWKQEKKVNIGSYLLEAMILYYYESKPDNTCSEYVDLELENVFNYLANSIINNVADPKNIQSNINDIDYYSRYSLSEKFKKFAQLSSDARQLEKEEKLKESINAWKKVFGDNFPDYG

SEQ ID NO: 4751 - protein, 336 aa, Acinetobacter sp.
MATTVISAFNDFQKNIVNLDSTTSTTARSSRNWLLDQISKFPENNDNFPNLYPEIDIGFGSFARKTKTRPLNDIDLMVGIKADGCTYYERSWDDIELNFPDNYSGKLKKYAKTFDSSALSSTRITNAFKSELSKVSQYSSAEIKRDGEAATLKLKSYTWNFDIVPCFLTSPDSYGNSYYLIPNRSGSWKKTNPKTDRDRLSVVNQNQSGKVLNVIRILKYWKQEKRVNIGSYLLEAMILYYYESKSNNTCSVYVDLELENVFNYLANSIINNVADPKNIQSNINDIDHYSRYSLSETFKKFAQLSSDARQLENEKKYRESINAWKKVFGDKFPDYG

SEQ ID NO: 4752 - protein, 336 aa, Acinetobacter pittii
MATTVTGAFNTFQKDIVNLDSSTTINARSSRNWLLEQIAKFPDKNSNFPILYPDINIAFGSFARKTKTRPLDDIDLMVGISADGCYYSENSWDDISLCFPDNYTGKLKNYADTRNSSYLSSTRITNAFKTELGNISQYSSAEIKRDGEAATLKLVSYSWNFDIVPCFFTKPDIFGNTYYLIPNRNGGWKKTDPRLDRDRLSAVNQNQAGNVLNVIRILKYWKQEKRVNIGSYLLEAMVLYYYESKSNNTCSKYVDLELENVFNYLANSILNTVADPKKIQNNINDFDYYDRYSLSEKFKKFAQLSNEARQLEIDQKIERSINKWKEVFGDNFPDYG

SEQ ID NO: 4753 - protein, 336 aa, Acinetobacter baumannii
MAITVTSAFNEFQKNIVNLDPEITATARSSRNWLLDQISKFPENNNSFPILYPEINVGFGSFARKTKTRPLDDIDLMIGINANGCTYYERSWDNIELNFPENYSGRLKNYAKILDSSTLSSTRITNAFKSELSKISQYSSAEIKREGEATTLKLKSYTWNFDIVPCFLTAPDYYGNSYYLIPNRIGNWKKTNPKIDRDRLIKVNQKQAGRVLNIIRILKYWKQEKKVNIGSYLLEAMILYYYENLPDNYCSEYVDLELENIFTYLAYKILSTVADPKGIQTDINDIDYFGRHSLHNTFLKFSQLSNRARQFENNGNMKDSIQEWKKVFGESFPDYG

SEQ ID NO: 4754 - protein, 340 aa, Raoultella ornithinolytica
MYEKIKGLNMATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKSRLQDVAQYAQADIRRNQEAVTLKLVSKDWNFDIVPCFITSEDAFGRTYYLIPDGNGHWKFTDPRKDRDRVTTINVQNDGNVLNVIRAVKYWQRRPTMPSMSSYLLETLILDYYAVRTSCLSFVDMELESLFRHLGLFVQYSVNDPKGIQGDINSLSAEARKAISDRCYLDAQKASEARRFEDNKEYEKSINKWRDVFGPSFPVYG

SEQ ID NO: 4755 - protein, 331 aa, Unknown
  Description of Unknown: Enterobacterales sequence
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKSRLQDVAQYAQADIRRNQEAVTLKLVSKDWNFDIVPCFITSEDAFGRTYYLIPDGNGHWKFTDPRKDRDRVTTINVQNDGNVLNVIRAVKYWQRRPTMPSMSSYLLETLILDYYAVRTSCLSFVDMELESLFRHLGLFVQYSVNDPKGIQGDINSLSAEARKAISDRCYLDAQKASEARRFEDNKEYEKSINKWRDVFGPSFPVYG

SEQ ID NO: 4756 - protein, 331 aa, Klebsiella pneumoniae
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKSRLQDVAQYAQADIRRNQEAVTLKLVSKDWNFDIVPCFITSEDAFGRTYYLIPDGNGHWKFTDPRKDRDRVTTINVQNDGNVLNVIRAVKYWQRRPTMPSMSSYLLETLILDYYAVRTSCLSFVDMELESLFRHLGLFVQYSVNDPKGIQGDINSLSAEARKAISDRCYLDAQKASEARLFEDNKEYEKSINKWRDVFGPSFPVYG

SEQ ID NO: 4757 - protein, 331 aa, Klebsiella oxytoca
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKSRLQDVAQYAQADIRRNQEAVTLKLVSKDWNFDIVPCFITSEDAFGRTYYLIPDGNGHWKFTDPRKDRDRVTTINVQNDGNVLNVIRAVKYWQRRPTMPSMSSYLLETLILDYYAVRTSCLSFVDMELEALFRHLGLFVQYSVNDPKGIQGDINSLSAEARKAISDRCYLDAQKASEARRFEDNKEYEKSINKWRDVFGPSFPVYG

SEQ ID NO: 4758 - protein, 331 aa, Klebsiella quasipneumoniae
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYCHSGADTVCSVRILNAFKSRLQDVAQYAQADIRRNQEAVTLKLVSKDWNFDIVPCFITSEDAYGKTYYLIPDGNGHWKFTDPRIDRDRVKAINVKNDGNVLNVIRAVKYWQRRTTMPSMSSYLLETLILDYYAGRTSCLSFVDMELEALFRHIGYFVQFSVNDPKGIQGDINSLSAEARKAISDRCYLDAQKASEARQFEDNKEYEKSINKWRDVFGPSFPVYG

SEQ ID NO: 4759 - protein, 331 aa, Rahnella sp.
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKSRLQDIAQYAQADIRRNQEAVTLKLVSKDWNFDVVPCFITSEDAYGKTYYLIPDGNGHWKFTDPRIDRDRVKSINVKNDGNVLNVIRAVKYWQRRSTMPSMSSYLLETLILDYYAGRTSCLSFVDMELEALFRHLGLFVQFSVNDPKGIQGDINSLSDEARKAISDRCYLDAQKASEARQFENNKEYEKSINKWRDVFGPSFPVYG

SEQ ID NO: 4760 - protein, 331 aa, Hafnia alvei
MATTVIAAFNEFMKDTVNLEKADTDDARASRDWLIGKINDFENDEVFPMSYPGIHIAFGSFARRTKIRPLDDIDLMFGLTGQGATYTILSDRVTVTSSGEGSRLHRYRHSGADTVCSVRILNAFKSRLQDIAQYAQADIRRNQEAVTLKLVSKDWNFDIVPCFITSEDAYGKTYYLIPDGNGHWKFTDPRIDRDRVKSINVKNDGNVLNVIRAVKYWQRRSTMPSMSSYLLETLILDYYAGRTSCLSFVDMELEALFRHLGLFVQFSVNDPKGIQGDINSLSDEARKAISDRCYLDAQKASEARQFENNKEYEKSINKWRDVFGPSFPVYG

SEQ ID NO: 4761 - protein, 331 aa, Klebsiella pneumoniae
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYQHSGADTVCSVRILNAFKSRLQDIAQYAQADIRRNQEAVTLKLVSKDWNFDIVPCFITSEDAYGKTYYLIPDGNGHWKFTDPRIDRDRVKAINVKNDGNVLNVIRAVKYWQRRSTMPSMNSYLLETLILDYYAGRTSCLSFVDMELEALFRHLGLFVQFSVNDPKGIQGDINSLSAEARKAISDRCYLDAQKASEARQFENNKEYEKSINKWRDVFGPSFPVYG

SEQ ID NO: 4762 - protein, 331 aa, Unknown
  Description of Unknown: Enterobacteriaceae sequence
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKNRLQDIAQYAQADIRRNQEAVTLKLVSKDWNFDIVPCFITSEDAYGKTYYLIPDGNGHWKFTDPRIDRDRVKAINVKNDGNVLNVIRAVKYWQLRSTMPSMSSYLLETLILDYYAGRTSCLSFVDMELEALFRHLGLFVQFSVNDPKGIQGDINSLSAEARKAISDRCYLDAQKASEARQFENDKEYEKSINKWRDVFGPSFPVYG

SEQ ID NO: 4763 - protein, 331 aa, Enterobacter cloacae
MATTVIAAFNEFMKDTVNLEKADTDDARASRDWLIGKINDFENDEVFPVSYPGIHIAFGSFARRTKIRPLDDIDLMFGLTGQGATYTILSDRVTVTSSGEGSRLHRYRHSGADTVCSVRILNAFKNRLQDIAQYAQADIRRNQEAVTLKLVSKDWNFDIVPCFITSEDAYGKTYYLIPDGNGHWKFTDPRIDRDRVKAINVKNDGNVLNVIRAVKYWQRRSTMPSMSSYLLETLILDYYAGRTSCLSFVDMELEALFRHLGYFVQFSVNDPKGIQGDINSLSAEARKAISDRCYLDAQKASEARQFENDKEYEKSINKWRDVFGPSFPVYG

SEQ ID NO: 4764 - protein, 331 aa, Unknown
  Description of Unknown: Enterobacteriaceae sequence
MATTVIAAFNEFMKDTVNLEKADTDDARASRDWLIGKISDFENDEVFPVSYPGIHIAFGSFARRTKIRPLDDIDLMFGLTGQGATYTILSDRVTVTSSGEGSRLHRYRHSGADTVCSVRILNAFKNRLQDIAQYAQADIRRNQEAVTLKLVSKDWNFDIVPCFITSEDAYGKTYYLIPDGNGHWKFTDPRIDRDRVKAINVKNDGNVLNVIRAVKYWQRRSTMPSMSSYLLETLILDYYASRTSCLSFVDMELEALFRHLGLFVQFSVNDPKGIQGDINSLSAEARKAISDRCYLDAQKASEARQFENNKEFEKSINKWRDVFGPSFPVYG

SEQ ID NO: 4765 - protein, 331 aa, Klebsiella variicola
MATTVIAAFNEFMKDTVNLEKADTDDARASRDWLISKINDFENDEVFPVSYPGIHIAFGSFARRTKIRPLDDIDLMFGLTGQGATYTILSDRVTVTSSGEGSRLHRYRHSGADTVCSVRILNAFKSRLQDIAQYAQADIRRNQEAVTLKLVSKDWNFDIVPCFITSEDAYGKTYYLIPNGNGHWKFTDPRIDRDRVKAINVKNNGNVLNVIRAVKYWQRRSTMPSMSSYLLETLILDYYAGRTSCLSFVDMELEALFRHLGLFVQFSVNDPKGIQGDINSLSAEARKAISDRCYLDAQKASEARQFENNKEYEKSINKWRDVFGPSFPVYG

SEQ ID NO: 4766 - protein, 331 aa, Shigella sonnei
MATTVIAAFNEFMKDTVNLKKADTDDARASRDWLIGKINDFENDEVFPVSYPGIHIAFGSFARRTKIRPLDDIDLMFGLTGQGATYTILSDRVTITSSGEGSRLHRYRHSGADTVCSVRILNAFKSRLQDIAQYAQADIRRNQEAVTLKLVSKDWNFDIVPCFITSEDAYGKTYYLIPDGNGHWKFTDPRKDRDRVTTINVQNDGNVLNVIRAVKYWQRRSTMPSMSSYLLETLILDYYAGRTSCLSFVDMELEALFRHLSHFVQFSVNDPKGIQGDINSLSAEARKAISDRCYLDAQKASEARQFENNKEYEKSINKWRDVFGPSFPVYG

SEQ ID NO: 4767 - protein, 225 aa, Klebsiella pneumoniae
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMHP

SEQ ID NO: 4768 - protein, 246 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRHCCK

SEQ ID NO: 4769 - protein, 331 aa, Unknown
  Description of Unknown: Enterobacteriaceae sequence
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4770 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGARLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4771 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINMQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4772 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGARLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWHRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4773 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADIVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4774 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKISEARWFENNKEYEKSINKWRDVFGPFFPVYG

SEQ ID NO: 4775 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKSIQGDINSLSAEARKAISDRCYLDAQKVSEARWFENNKEYEKSINKWRDVFGPFFPVYG

SEQ ID NO: 4776 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTAPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4777 - protein, 331 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTAPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKISEARWFENNKEYEKSINKWRDVFGPFFPVYG

SEQ ID NO: 4778 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYSLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4779 - protein, 336 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSPFVDMELEALFRHLGQSVRYSVNDPKGIQGDINSLSAEARKAISDRCYLDAQKVSEARRFENNKEYEKSINKWRDVFGPFFCSGTLNLAT

SEQ ID NO: 4780 - protein, 232 aa, Escherichia coli
MATTVIAAFNEFMKDTVNIKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMRKRLVRTVL

SEQ ID NO: 4781 - protein, 163 aa, Escherichia coli
MATTVIAAFNEFMKDTVNLKKADTDDARASRDWLIGKINDFENDEVFPVSYPGIHIAFGSFARRTKIRPLDDIDLMFGLTGQGATYTILSDRVTITSSGEGSRLHRYRHSGADTVCSVRILNAFKSRLQDIAQYAQADIRRNQEAVTLKLVSKDWNFDFADRP

SEQ ID NO: 4782 - protein, 325 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGP

SEQ ID NO: 4783 - protein, 331 aa, Unknown
  Description of Unknown: Enterobacteriaceae sequence
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSPFVDMELEALFRHLGQSVRYSVNDPKGIQGDINSLSAEARKAISDRCYLDAQKVSEARRFENNKEYEKSINKWRDVFGPFFPVYG

SEQ ID NO: 4784 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYAILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSPFVDMELEALFRHLGQSVRYSVNDPKGIQGDINSLSAEARKAISDRCYLDAQKVSEARRFENNKEYEKSINKWRDVFGPFFPVYG

SEQ ID NO: 4785 - protein, 337 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4786 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSREGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4787 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFCHLGQSVRYSVNDPKGIQGDINSLSAEARKAISDRCYLDAQKVSEARWFENNKEYEKSINKWRDVFGPFFPVYG

SEQ ID NO: 4788 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDTQKVSEARWFENNKEYEKSINKWRDVFGPFFPVYG

SEQ ID NO: 4789 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSADAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4790 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRVVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGSFFPVYG

SEQ ID NO: 4791 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGKGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4792 - protein, 331 aa, Shigella sonnei
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYASRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4793 - protein, 331 aa, Salmonella enterica
MATTVIAAFNEFMKDTVNLKKADTDDARASRDWLIGKMNDFEKDDQFPVSYPAIHIAFGSFARRTKIRPLDDIDLMFGLTGQGATYTILSDRITVTSSGEGSRLHRYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNDGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARRFENNKEYEKSINKWRDVFGPFFPVYG

SEQ ID NO: 4794 - protein, 331 aa, Salmonella enterica; identical to SEQ ID NO: 4793

SEQ ID NO: 4795 - protein, 331 aa, Escherichia coli
MATTVIAAFNEFMKDTVNLRKADTDDARASRDWLIGKMNDFENEEVFPVSYPGLHIAFGSFARRTKIRPLDDIDLMFGLTGQGATYTILSDRITVTSSGEGSRLHRYRHPGADTVCSVRILNAFKNRLQDIAQYAQADIRRNQEAVTLKLVSKDWNFDIVPCFITSEDAFGRTYYLIPDGNGHWKFTDPRKDRDRVTTVNVQNDGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARRFENNKEYEKSINKWRDVFGPFFPVYG

SEQ ID NO: 4796 - protein, 331 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEESRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPMMPSMSSYLLETLILDYYAGRTSCSSFVDMELEALFRHLGQSVRYSVNDPKGIQGDINSLLAEARKAISDRCYLDAQKVSEARWFENNKEYEKSINKWRDVFGPFFPVYG

SEQ ID NO: 4797 - protein, 216 aa, Escherichia coli
MATTVIAAFNEFMKDTVNLKKADTDDARASRDWLIGKMNDFEKDDKFPVSFPAIHIAFGSFARRTKIRPLDDIDLMFGLTGQGATYTILSDRITVTSSGEESRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAGLC

SEQ ID NO: 4798 - protein, 298 aa, Escherichia coli
LCNSANDFEKDDKFPVSFPAIHIAFGSFARRTKIRPLDDIDLMFGLTGQGATYTILSDRITVTSSGEGSRLHSYRHSGADTVCSVRILNAFKNRLQDIAQYAQADIRRNQEAVTLKLVSKDWNFDIVPCFITSEDAFGRTYYLIPDGNGHWKFTDPRKDRDRVTTINVQNNGNVLNVIRAVKYWQRRPTMPSMSSYLLETLILDYYAGRTSCSSFVDMELEALFRHLGQSVRYSVNDPKGIQGDINSLSAEARKAISDRCYLDAQKVSEARWFENNKEYEKSINKWRDVFGPFFPVYG

SEQ ID NO: 4799 - protein, 319 aa, Enterobacter cloacae
MKDIVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEENNEYEKSINKWRDVFGPFFPVYG

SEQ ID NO: 4800 - protein, 331 aa, Unknown
  Description of Unknown: Enterobacter cloacae complex sequence
MATTVIAAFNEFMKDIVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEENNEYEKSINKWRDVFGPFFPVYG

SEQ ID NO: 4801 - protein, 331 aa, Enterobacter asburiae
MATTVIAAFNEFMKDIVNLKKADTDDARASRDWLIGKMNDFEKDDKFPVSYPAIHIDFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDLNSLSAEARKAISDRCYLDAQKVSEARWFEENNEYEKSINKWRDVFGPFFPVYG

SEQ ID NO: 4802 - protein, 331 aa, Klebsiella oxytoca
MATTVIAAFNEFMKDIVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEVNKEYEKSINKWRDVFGPFFPVYG

SEQ ID NO: 4803 - protein, 331 aa, Unknown; identical to SEQ ID NO: 4802
  Description of Unknown: Klebsiella sequence

SEQ ID NO: 4804 - protein, 331 aa, Escherichia coli
MATTVIAAFNEFMKDIVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEENKEYEKSINKWRDVFGPFFPVYG

SEQ ID NO: 4805 - protein, 331 aa, Serratia ureilytica
MATTVIAAFNEFMKDTVNLKKADTDDARASRDWLIGKMNDFEKEDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEENKEYEKSINKWRDVFGPFFPVYG

SEQ ID NO: 4806 - protein, 252 aa, Serratia marcescens
MATTVIAAFNEFMKDTVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRATGRRCPRCC

SEQ ID NO: 4807 - protein, 331 aa, Edwardsiella tarda
MATTVIAAFNEFMKDTVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITSEDAFGRTYYLIPDGKGHWKFTDPRKDRDRVTTVNVQNDGNVLNVIRAVKYWQRRPTMPSMSSYLLETLILDYYAGRSACSSFVDMELEALFRHLGLYVQFSVNDPKGIQGDINSLSAEARKAISDRCYLDAQKVSEARWFEENKEYEKSINKWRDVFGPLFPVYG

SEQ ID NO: 4808 - protein, 331 aa, Serratia marcescens
MATTVIAAFNEFMKDTVNLKKADTDDARASRDWLIGKMNDFEKDDKFPVSYPAIHIAFGSFARRTKIRPLDDIDLMFGLSAQSATYNVLSDRITLTSSGEGSRLHGYRHSGADTICSVRILNAFKNRLQDIAQYAQADIRRNQEAVTLKLVSKDWNFDIVPCFITNEDAFGRTYYLIPDGKGHWKFTDPRKDRDRVTTVNVQNDGNVLNVIRAVKYWQRRPTMPSMSSYLLETLILDYYAGRAACSSFVDMELEALFRHLGLYVQFSVNDPKGIQGDINSLSAEARKAISDRCYLDAQKVSEARWFEENKEYEKSINKWHDVFGPFFPVYG

SEQ ID NO: 4809 - protein, 331 aa, Enterobacter massiliensis
MATTVIAAFNEFMKDTVNLKKADTDDARASRDWLIGKMNDFEKDDKFPVSYPAIHIAFGSFARRTKIRPLDDIDLMFGLSAQSATYNVLSDRITLTSSGEGSRLHGYRHSGVDTICSVRILNAFKNHLQDIAQYAQADIRRNQEAVTLKLVSKDWNFDIVPCFITSEDVFGRTYYLIPDGNGHWKFTDPRKDRDRVTTINVQNDGNVLNVIRAVKYWQRRPTMPSMSSYLLETLILDYYAGRTSCSSFVDMELEALFRHLGLFVQFSVNDPKGIQGDINSLSAEARKAISDRCYLDAQKASEARRFEDNKEYEKSINKWRDVFGPSFPVYG

SEQ ID NO: 4810 - protein, 331 aa, Citrobacter sp.
MATTVIAAFNEFMKDTVNLKKADTDDARASRDWLIGKMSDFEKDDKFPVSYPAIHIAFGSFARRTKIRPLDDIDLMFGLSAQSATYNVLSDRITLTSSGEGSRLHGYRHSGADTICSVRILNAFKNHLQDIAQYAQADIRRNQEAVTLKLVSKDWNFDIVPCFITSEDVFGRTYYLIPDGNGHWKFTDPRKDRDRVTAINVQNDGNVLNVIRAVKYWQRRPTMPSMSSYLLETLILDYYAGRTSCSSFVDMELEALFRHLGLLVQFSVNDPRGIQGDINSLSAEARKAISDRCYLDAQKASEARRFEDNKEYEKSINKWRDVFGPSFPVYG

SEQ ID NO: 4811 - protein, 331 aa, Yersinia frederiksenii
MATTVIAAFNEFMKDTVNLKKADTDDARASRDWLIGKMNDFEKDDKFPVSYPAIHIAFGSFARRTKIRPLDDIDLMFGLSAQSATYNVLSDRITLTSSGEGSRLHGYRHSGAATICSVRILNAFKNRLQDIAQYAQADIRRNQEAVTLKLVSKDWNFDIVPCFITSEDVFGRTYYLIPDGNGHWKFTDPRKDRDRVITINVQNDGNVLNVIRAVKYWQRRPTMPSMSSYLLETLILDYYAGRTSCSSFVDMELEALFRHLGLFVQFSVNDPKGIQGDINFLSAEARKAISDRCYLDAQKASEARRFEDNKEYEKSINKWRDVFGPSFPVYG

SEQ ID NO: 4812 - protein, 331 aa, Pectobacterium carotovorum
MATTVIAAFNEFMKDTVNLKKADTDDARASRDWLIGKMNDFEKDDEFPVSYPAIHIAFGSFARRTKIRPLDDIDLMFGLSAQSATYNVLSDRISLTSSGEGSRLHGYRHSGADTICSVRILNAFKNRLQDIAQYAQADIRRNQEAVTLKLVSKDWNFDIVPCFITSEDVFGRTYYLIPDGNGHWKFTDPRKDRDRVITINVQNDGNVLNVIRAVKYWQRRPTMPSMSSYLLETLILDYYAGRTSCSSFVDMELEALLRHLGLFVQFSVNDPKGIQGDINFLSAEARKAISDRCYLDAQKASEARWFEDNKEYGKSINKWRDVFGPSFPVYG

SEQ ID NO: 4813 - protein, 331 aa, Klebsiella aerogenes
MATTVIAAFNEFMKDTVNLKKADTDDARASRDWLIGKINDFEKDDKFPVSYPAIHIAFGSFARRTKIRPLDDIDLMFGLSAQSATYNVLSDRVTLTSSGEGSRLHGYRHSGADTICSVRILNAFKNRLQDIAQYAQAEIRRNQEAVTLKLVSKDWNFDIVPCFITSEDVFGRTYYLIPDGNGHWKFTDPRKDRDRVTTINVQNDGNVLNVIRAVKYWQRRPTMPSMSSYLLETLILDYYAGRTSCSSFVDMELEALFRHIGLFVQFSVNDPKGIQGDINFLSAEARKAISDRCYLDAQKASEARRFEDNKEYEKSINKWRDVFGPSFPVYG

SEQ ID NO: 4814 - protein, 331 aa, Klebsiella pneumoniae
MVTTVVAAFNEFMKDTVNLRKADTDDARASRDWLIGKINDFEKDNAFPVSYPAIHIAFGSFARRTKIRPLDDIDLMFGLSAQGATYNILSDRITLTSSGEGSRLHGYRHSGADTICSVRILNAFKSHLQDIAQYAQADIRRNQEAVTLKLISKDWNFDIVPCFMTSEDVFGRTNYLIPDGNGHWKFTDPRKDRDRVTTINVQNDGNVLNVIRAVKYWQRRPTMPSMSSYLLETLILDYYASRTSCSSFVDIELEALFRHLGLFVQFSVNDPKGIQGDINSLSAEARQAISDRCYLDAQKASEARWFEKGKEYEKSINKWRDLFGPFFPIYG

SEQ ID NO: 4815 - protein, 331 aa, Klebsiella pneumoniae
MVTTVVAAFNEFMKDTVNLRKADTDDARASRDWLIGKINDFEKDNAFPVSYPAIHIAFGSFARRTKIRPLDDIDLMFGLSAQGATYNILSDRITLTSSGEGSRLHGYRHSGADTICSVRILNAFKSHLQDIAQYAQADIRRNQEAVTLKLISKDWNFDIVPCFMTSEDVFGRTNYLIPDGNGHWKFTDPRKDRDRVTTINVQNDGNVLNVIRAVKYWQRRPTMPSMSSYLLETLILDYYASRTSCSSFVDIELEALFRHLGLFVQFSVNDPKGIQGDINSLSAEARQAISDRCYLDAQKASEARWFEKGKEYEKSINKWRDVFGPFFPIYG

SEQ ID NO: 4816 - protein, 331 aa, Klebsiella pneumoniae
MATTVIAAFNEFMKDTVNLKKTDTDDARASRDWLIGKINDFEKDGTFPVNHPDIHIAFGSFARRTKIRPLDDIDLMLGLSAESATHTIYSDHIALNSSGENTRLHQYRHTGENTICSVRILNAFKNRLQGVSQYAQAEIRRNQEAVTLNLSSKDWNFDIVPCFISTADAFGKNYYLIPDGKGHWKKTDPRVDRNRVSDINVKNDGNVLNVIRAVKYWQRRPTMPAMSSYLLETMILDYYTNKTNCSKFIDMELQALFNHLGLFVKYSVNDPKGIQGDINTLSMDARQKISDRCYLDAQRAAEARQFERDNDHEKSINKWQEVFGPHFPAYG

SEQ ID NO: 4817 - protein, 331 aa, Enterobacter muelleri
MARTVISAFGEFMKDIVNLRKEDTDDARASRNWLISKINNFENDGIFPVNHPGIHIAFGSFARRTKIRPLDDIDLMFGLSAESATHTIYSDRITLNSAGESTRLHQYRHSGENTICSVRILNAFKSRLQDIAQYAQADIKRNQEAVTLNLSSKDWNFDIVPCFSSTTDASGNNYYLIPDGKGHWKKTDPRIDRDRVTNINVKNGGNVLNVIRAVKYWQRRPTMPTMSSYLLETLILEYYENKTSCSEYVDMELKDLFSHIGLFVKYSVNDPKGIQGDINSLTAEARQKISDRCYLDAQKAAEARQFERDKDYEKSINKWREVFGSQFPDYG

SEQ ID NO: 4818 - protein, 331 aa, Pantoea sp.
MATTVTSAFSEFMSDVVNLRKSSTDDARTSRDWLYEKLNGFESDAASPKNYPEIHIGFGSFARRTKIRPLDDIDLMFGLSAEGCTYTIYSDRITLNSDDTPRRLNNFRHPDSQTISSVRILNHFKNKLQNIPQYEKADLKRNQEAVTLQLSTKTWNFDIVPCFITHADVLGRSYYLIPDGSGNWKKTDPRIDKARTTEINVKNSGNMLNVIRAVKYWQTTKALPSIGSYLLETLILNYYEHRTTCQQWVDLELEGLFNHLSFYIRYSVNDHKNIQGDINHLSYEAREKISQKFSSEALKVSEARGLEKNNEHQKSINKWREIFGSDFPAFG

SEQ ID NO: 4819 - protein, 331 aa, Serratia marcescens
MATTVINAFNEFLQNTVNLEKANTDDARASRDWLIDKMDSFESDGDSPLNYPDIHIGFGSFARRTKIRPLDDIDLMFGLSAEGCTYTIYNDKITLNLGEGATRLSNFKHNDGETISSIKILNNFKSNLKNIPQYKIADIKRNQEAVTLQLSSKAWSFDIVPCFKTKEDVFGKTYYLIPDGMGNWKKTDPRIDKERTTKINVENNGNVLNVIRVVKYWQTKKAIPSIGSYLLETMILNYYDGKSNCSNFVDLELKNIFNHLGFYINFSVNDHKGIQGDINHLSHDERGRVSEKFYSEAKKVEEARGFEEEKEYEKSINKWIEIFGVQFPRYG

SEQ ID NO: 4820 - protein, 344 aa, Psychrobacter sp.
MATTVIQAFNEFMKETVNLDQARVAKARSSRNWLLSKIALFPTNDTSFPFLHGAYNLNYGSFERKTKTRPLDDIDTMMGINADGCSYLESTVDNIKIYFPDNYNGRLNNFRHTTLGKENTLSSTRIVNKFVKNLGEIDQYAKAEIKRTGEAATLKLTSYEWNFDLLPCFMTSEEADGRNYYLIPNGNGDWRKTDPRKDRVRLSSINQACSGNILNVIRALKYWNQRTYQVTIPSYLLETMISDYYQNEINLSKNNDVSEFVDIEIIKVLEYLTNNIFMTVNDPKGISYNINALSFEQQLAIQNRMNNSLEKARLARQYEFDGKQKESIKKWQDFFGGTFPDYTG

SEQ ID NO: 4821 - protein, 345 aa, Acinetobacter tandoii
MATSVIKAFDDFMKETVNLDQSRVATARNSRNWLLDRIASFPENDLSFPILHNEYNLNYGSFERKTKTRPLDDIDMMIGIKADGCTYIETNVNDVKIYFPDHYNGRLNAFRHTTYGKESTLSSTRVVNKFIKNLCEIDQYSKAEIKRTGEAATLKLISYEWNFDLLPCFMTTSESDGRSYYLIPNGNGDWKKTDPRKDRARLSSINQSCNGYVLNVIRAFKYWNQRPYQTRLPSYLLETMISDYYQNEIHYSRSSQVSKYVDMEFIKVLEYLIDNIYLTVHDPKDITYNINDLNFEHQQSMRTRFSVTLEKARLARQYESDTKPKESIKKWREIFGDDFPEYTGT

SEQ ID NO: 4822 - protein, 344 aa, Moraxella osloensis
MAKNVVEAFNEFLKDKVNIDKSKSDTAKASRDWLINKINNFPQNDLSFPLLYEASHLNYGSFERKTKTRPLDDIDIMICLNADGWSYFENSVDDITLRPPSNYSGRLNAFKSTVQWQENNLSSTRILNRFIKNLNTISQYSKAEIKKNGVATVLKLTSYDWNFDIVPCFRTAVDYYDKSYYLIPNGNGNWKKTDPRVDRARLQSINQACNGKVLNVIRLFKFWNQIPYKSKLSSSYLLETMISNYYQEIINQGLQNDVTVYPDIEFVKVANYIIQNIYNVVSDPKNIDGNINIISYSEKLAVKIRLERDLEKSRNARILESNEKQEESIKLWREIFGEQFPNYG

SEQ ID NO: 4823 - protein, 330 aa, Vibrio tasmaniensis
MATNVNDAFDQFMTNNVNLDNLEVSTARSSRNWLVEQLNAFPEKYEDFPYLYTSKHMGFGSFARSTKKRELDDIDHLICMNADGVTYSEIGDTIFMHVPDNAKIFKGLLQTDSSYLSSIKVVNRFVKYLQEIPQYSCAEIKRNQEAATLKLTSYSWNFDIVPCFFTKEDLFGKTYYLIPDGKGNWKKTDPRKDKERTTRINQDHDGKILKVIRAVKYWSNVKHMPKIGSYLLENMILDYYESNTATSWVDIEVRNVLYYISSAIYNQVQDPKGIQGNINYLSNEERSTISSKALGDAQKGQVALDNEQSNVAYAISKWREVFGPNFPTYG

SEQ ID NO: 4824 - protein, 330 aa, Alteromonadales bacterium
MATTVNSAFNKFMKDYVNLDSDQVVKARASRNWLIKQINNFPGKNDDFPALYEEKHFGFGSFARSTKKRNLDDIDHLVCMKAQGLTYTEYSDTIYIHVPDDIKPFSKLMQTNADYLSSIKVVNRFVKHLDAIPQYKKAEIKRNQEAATLQLSTYEWNFDIVPCFYTTEDSNGKSFYIIPDGNGNWKKTDPRLDKNRTTRVNQLRDGHVLQAIRAMKYWNKRQTMATMGSYLLENMILDYYENNSATQWIDIEVKYLLQYIKENIYSSVADPKGIQGNINTLTDDEKYSIFSRAYDDYARAVDASQSENSNPAYAIGKWRSIFGLNFPTYG

SEQ ID NO: 4825 - protein, 328 aa, Bacteroidetes bacterium
MPTTVNSAFAQFLKETVNLETERSKTARSSRDWLIRQINSLPERETDFPKLVEDFHLHYGSFARKTKTRPLDDIDIMIGLHAHGATHNVISHDLIKVYTNSNNLILNSLSNDGNTINSKMVINRFVKSLSNIYQYKSAEVNRRHEAAVLNLSSYDWSFDIVPCFQATDGYYIIPDGNGNWKKTDPRLDKSKTERINQAHDGNILNVIRIVKYWNKRRVVNTIPSYLLENMILNYYEIQNIKATSYVDMEFIKVMDYLVNAIYNYISDPKGIQGNLNNLSFDEKSNISNAALKYSDLAQEARRYEKNEDHKSAISKWSEVFGNTFPSYG

SEQ ID NO: 4826 - protein, 333 aa, Firmicutes bacterium
MASTVIQAFNEFLKDIVNLDSNITKRAISSRDWLMNQIANFKTKDSDFPKLYEDININFGSFARKTKIRELDDIDIMIGLNAQKSTYMTYSDRIEIAVSSDATDLLKLCHSNSTSLNSKRVINKFVSACSNVPQYSNAEIKRNQEAAVLNLSSYPWSFDIVPCFITSEDCYGKSYYLIPDGNGYWKKTDPRIDKERTTRINRNHDGNILQIIRMLKYWNRRATMPTMSSYLLETMILNYYEGQSSKASQFVDVEFPKVMAYIYNNITGNVDDPKGIQGNINSLTYDERTRIKNKTAIDYNVAIAASELEQNKDMKSSIGKWGDVFGSEFPKYN

SEQ ID NO: 4827 - protein, 333 aa, Desnuesiella massiliensis
MATTVIQAFNEFLKDIVNLDSDISKTARSSRDWLLGQISKFNEKDNTFPKLYSDINIHFGSFARKTKIRELDDIDLMIGLTGQGSTYTEYTDKIEINVADDAKDLLNLCHDYTNKLNSKKVINKFVSACSNVPQYSNADIKRNQEAATLQLSSYTWNFDIVPCFMTTTNIYGVSYYLIPDGNGHWKKTDPRIDKERISRINQTHDGNVLQVIRVMKYWNRRPTMPTMSSYLLETMILNYYEAKTTTASQYVDIELPDVIAYIHNNIMYDVNDPKNIQGNINKLTYDEKTKIKNKAYSDYYKAMEARQLEQDKDMKGSINKWREIFGDSFPKYE

SEQ ID NO: 4828 - protein, 333 aa, Unknown
  Description of Unknown: Clostridium sequence
MATTVIQAFNEFLKDIVNLDSDISKTARSSRDWLLGQISKFNEKDNTFPKLYSDINIHFGSFARKTKIRELDDIDLMIGLTGQGSTYTEYTDKIEINVADDAKDLLYLCHDYTNKLNSKKVINKFVSACSNVPQYSNADIKRNQEAATLQLSSYTWNFDIVPCFMTTTNIYGVSYYLIPDGNGHWKKTDPRIDKERISRINQTHDGNVLQVIRVMKYWNRRPTMPTMSSYLLETMILNYYEAKTTTASQYVDIELPDVIAYIHNNIMYDVNDPKNIQGNINKLTYDEKTKIKNKAYSDYYKAMEARQLEQDKDMKGSINKWREIFGDSFPKYE

SEQ ID NO: 4829 - protein, 333 aa, Dehalobacterium formicoaceticum
MATTVIQAFNEFLKDIVNLDSDISKTARSSRDWLLGQISKFDEKDNTFPKLYSDINIHFGSFARKTKIRELDDIDLMIGLTGQGSTYTEYTDKIEINVGDDAKDLLNLCHDYTNKLNSKKVINKFVSACSNVPQYSNADIKRNQEAATLQLSSYTWNFDIVPCFMTTTNIYGVSYYLIPDGNGHWKKTDPRIDKERTSRINQTHDGNVLQVIRVMKYWNRRPTMPTMSSYLLETMILNYYEAKTTTANQYVDIELPDVIAYIHNNIMYDVNDPKNIQGNINKLTYDEKTKIKNKAYSDYYKAIDARQLEKDKDMKGSINKWREIFGDSFPKYE

SEQ ID NO: 4830 - protein, 334 aa, Marinomonas polaris
MATTVIEAFNKFLADHVNLRDDETKIARASRDWLVGQICNFPSKVDHFPQVYTEKNIFFGSFARNTKKRPLDDIDIMICLNAQGSTYFEGLLSGISISVPEQSTQLRRLCNDGTDTLNSIKVVNKIVSALNNVPQYAGADTKRNQEAAVLSLTSYDWSYDIVPCFFTSPDTYGNSFYLIPDGSGSWKKTNPILDQNRTQAINTNHNGNVLNVIRSMKYWNKRPTMPSMSSYLLEVMILNYYSTRSDAASEFVDLELPKIFEYIWLNVTNDVTDPKGMQGNINHLTQVERDKISTRAWVDKNKAIEARQFESDKDHRSSIKKWGEIFGSNFPDYG

SEQ ID NO: 4831 - protein, 334 aa, Clostridium sp.
MAKTVISAFNEFLKDKVNLDSDVSKTARTSRDWLIDQIHTFTTKDDEFPSFYPEKDIFFGSFARKTKKRELDDIDIMICLNAQCSTYYEYSDHIEITVSDSATNLKKLCNDDTNILNSKKVINKFIANLKNIGQYRKSEIHRNQQAATLNLISYDWNFDIVPCFFTTEDSLGKTYYIIPDGNGNWMKTDPRIDRKKVSDINQNHNGNVLNVIRIIKYWNKRPTMPSMQSYLLENMILNYYNTAASCSEFVDIEVPNILSYISNAVYNPVNDPKGIQGNLNTLSYDEIKKISDRASSDYLKAIDAINYENNKDDESSINKWAEIFGGDFPEYDGE

SEQ ID NO: 4832 - protein, 334 aa, Clostridium sp.
MAKTVISAFNEFLKDKVNLDSDVSKTARTSRDWLIDQIHTFTTKDDEFPSFYQEKDIFFGSFARKTKKRELDDIDIMICLNAQCSTYYEYSDHIEITVSDSATNLKKLCNDDTNILNSKKVINKFIANLKNIGQYRKSEIHRNQQAATLNLISYDWNFDIVPCFFTTEDSLGKTYYIIPDGNGNWMKTDPRIDRKKVSDINQNHNGNVLNVIRIIKYWNKRPTMPSMQSYLLENMILNYYNTAASCSEFVDIEVPNILSYISNAVYNPVNDPKGIQGNLNTLSYDEIKKISDRASSDYLKAIDARNYENNKDDESSINKWAEIFGGDFPEYDGE

SEQ ID NO: 4833 - protein, 335 aa, Virgibacillus halodenitrificans
MATTVISAFNEFLRDIVNLDPDETKTARNSRNWLIEQQIHKFPEKDDLFPNLYKEKDFYFGSFARRTKIRKLDDIDIMIALSAEGGHYNESQHHVEITVANDADKLKKLCFENSNILNSRKVINKFLSLLKDVPQYEKAEMKRNQEAATLKLSSHGWNFDLVPCFFTKEDSFGRTYYLIPDGQGNWKKTDPRIDRDRVSSINQNNDGNVLNVIRIFKYWNKRASMPTIPSYLLENIILNYYAKNTHSKASEFVDMEIPKILNDIHSSIHSPVMDPSGIQDDINTLSYDTRSKISERSLNDYYVAEEARKCENERNYKDSISKWRDIFGSEFPEYT

SEQ ID NO: 4834 - protein, 335 aa, Paraliobacillus ryukyuensis
MATTVISAFNEFLRDIVNLDPDETKTAKNSRNWLIEQQIHKFPEKDDLFPNLYKEKDFYFGSFARRTKIRKLDDIDIMIALSAEGGHYNESQHHVEITVANDADKLKKLCFENSNILNSRKVINKFLSLLKDVPQYEKAEMKRNQEAATLKLSSHGWNFDLVPCFFTKEDSFGRTYYLIPDGQGNWKKTDPRIDRDRVSSINQNNDGNVLNVIRIFKYWNKRASMPTIPSYLLENIILNYYAKNTHSKASEFVDMEIPKILNDIHSSIHSTVMDPSGIQDDINTLSYDTRSKISERSLNDYYVAEEARKCENERNYKDSISKWRDIFGSEFPEYT

SEQ ID NO: 4835 - protein, 224 aa, Methylomarinum vadi
MANTVTSAFNEFLRDIVNLDSEQVKKARSSRDWLIEEIHKFPSKNSLFPELYSERDINFGSFARRTKKRPLDDIDMMICLSARGGTYHEYSHDNIDITIDSDVKSLKDLCNTFTNKLNSIKVVNKFVSALSGVPQYSALSGVPQYSKADINRRQEAAVLNLTSYDWTFDIVPCFFTQEDYYGKTFYLIPNGSGVWKKTDPRIDRDSVSTINQQNNGNVLNVISA

SEQ ID NO: 4836 - protein, 333 aa, Tenacibaculum sp.
MAKKVIAAFNEFMSDTVNLNKNRVKEARSSRDWLVKQIKGFPTDDNDFPFIHPDLYVYFGSFARRTKKRPLDDIDIIIVLHAKGNSYNEYLSNIEITATESADRQLKLCHDNTRDINSVKVINKFIKALEGIDQYKHAEIKRNQESATLQLKSKDWNFDIVPAFITNEDINGKTFYLIPDGKGNWKKTDPRLDRDRTTKVNQDNKGRILNVIRAVKYWNKRPTMPTMGSYLLENMILDYYENSNSEASEYVDIELVNIFKDLKSRVHNNVNDPKNIQGNINNLSSVEKNKISNRASIDYDRAKEARKFEREENHKESINKWREIFGIDFPKYE

SEQ ID NO: 4837 - protein, 333 aa, Methylovulum psychrotolerans
MASTVISAFNEFLKDTVNLDADDVKSARISRTLLKGKIHDFPIHDSSFPALYSEKDINFGSFDRNTKKRLLDDIDMMICLNAMGGTYLEYSHDNIEITIDYNEKNLKYLCNPNTYQLNSIKVVNKFVSSLSSVSQYKNSQINRRQEAAVLNLTSYDWSFDIVPCFFTREDSYGKTFYLIPNGSGSWKKTDPRIDQEKVSDINQKNKGNVLNVIRIMKFWNKRPTMPSMSSYLIENMILNYYEYRDDASNYVDMELPNIFLYIRNNVYNSVQDPKGIQGNINHLTYDEKSKIWDRANFDYDRSVEARSLEDQGKQKESINKWREIFGSEFPTYW

SEQ ID NO: 4838 - protein, 257 aa, Escherichia coli
MATTVISAFNEFLKESVNLDSNKTITARSSRDWLISKINNFDNNQSFPYIYQDIHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETILLNYYDNKSYCSPYVDIELEGVF

SEQ ID NO: 4839 - protein, 241 aa, Escherichia coli
NLDSNKTITARSSRDWLISKINNFDNNQSFPYIYQDIHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETILLNYYDNKSYCSPYVDIELEGVFR

SEQ ID NO: 4840 - protein, 331 aa, Escherichia coli
MATTVISAFNEFLKESVNLDSNKTITARSSRDWLISKINNFDNNQSFPYIYQDIHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETILLNYYDNKSYCSPYVDIELEGVFRHISDVIYHTVNDHKNIQGDINNLPWDDRVKISNKALSDAEKVNLARDLEEKYDYQKSINVWREIFGDAFPQYG

SEQ ID NO: 4841 - protein, 331 aa, Escherichia coli
MATTVISAFNEFLKESVNLDSNKTITARSSRDWLISKINNFDNNQSFPYIYQDIHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETISLNYYDNKSYCSPYVDIELEGVFRHISDVIYNTVNDHKNIQGDINNLPWDDRVKISNKALSDAEKVNLARDLEEKYDYQKSINVWREIFGDAFPQYG

SEQ ID NO: 4842 - protein, 238 aa, Escherichia coli
MATTVISAFNEFLKESVNLDSNKTITARSSRDWLISKINNFDNNQSFPYIYQDVHINFGSFARRTKIRPLDDIDIMIGIKSDYCTYYENNEDIKILIDSNTARLNNYTHDNTTYVNSRKIINLFVSELSKIEQYSSSEINRRQEAATLKLKSYDWNFDIVPCFITVPDIYDRTFYLIPDGNGHWKKTDPRIDKNRTTDINVKHDGNMLNVIRIVKYWQKRKTMPTMSSYLLETILLNY

SEQ ID NO: 4843 - protein, 331 aa, Salmonella enterica
MATTVISAFNEFLKEIVNLDSNKTITARSSRDWLISKINNFDNNQSFPYIYQDIHINFGSFARRTKIRPLDDIDIMIGIKSDYCTYYENNEDIKILTGSNTARLNNYTHDNTTYLNSRKIINLFVSELSKIEQYSSSEINRRQEAATLKLKSYDWNFDIVPCFMTMPDIYDRTFYLIPDGNGHWKKTDPRIDKNRTTDINVKHNGNMLNVIRIVKYWQKRKTMPTMSSYLLETILLNYYDNKLYCSPYVDIELEGVFRHISDVIYNTVNDHKNIQGDINNLPWDDRVKISNKALLDADKVTLARYLEEKDDYQKSIDVWREIFGDAFPQYG

SEQ ID NO: 4844 - protein, 335 aa, Serratia marcescens
MATTVTSAFNQFMKDTVNLSKDRTDKARGSRDWLLERITSLPQKDAKFPTLYSNADIHFGSFSRRTKIRPLDDIDLMIGLDGDGCTYSVENDRIVINTNESTEKLNGYTHNYPNNNLLNSRKIIEIFKSGLKNISQYEDADINRNQEATTLKLSSYEWNFDIVPCFITRKDSLENNFYLIPDGNGHWKKTDPRIDKKRTTDINVRLDGNVLNVIRVTKYWQKRSTMPTMSSYLLETILLNYYSTRNDCSSYVDLELEGIFNHLSNVVYNKVNDTKGFIDDLNNLTQDERDKISKKALADRDRVQEARGLEFIDPEKAIRIWRDIFGNDFPTYGDN

SEQ ID NO: 4845 - protein, 335 aa, Serratia marcescens
MATTVTSAFNQFMKDTVNLSKDRTDKARGSRDWLLERITSLPQKDAKFPTLYSNADIHFGSFSRRTKIRPLDDIDLMIGLDGDGCTYSVENDRIVINTNESTEKLNGYTHNYPNNNLLNSRKIIEIFKSGLKNISQYEDADINRNQEATTLKLSSYEWNFDIVPCFITRKDSMENNFYLIPDGNGHWKKTDPRIDKKRTTDINVRLDGNVLNVIRVTKYWQKRSTMPTMSSYLLETILLNYYSTRNDCSSYVDLELEGVFNHLSNVVYNKVNDTKGFIDDLNNLTQDERDKISKKALADRDRVQEARGLEFTDPEKAIRIWRDIFGNDFPTYGDK

SEQ ID NO: 4846 - protein, 335 aa, Salmonella enterica
MATTVTSAFSQFMKDTVNLAKDRTDKARGSRDWLLEQIKSLPEKDAKFPTLYSNIDIHFGSFSRRTKIRPLDDIDLMIGLDGDGCTYSVEDERIVINTNESTEKLKNYTHNYPNNSLVNSRKIIEIFKSGLKDISQYEDADIKRNQEATTLKLKSYEWNFDIVPCFITREDSLGNNFYLIPDGYGHWKKTDPRIDKKRTTDINVRLNGNVLDVIRVTKFWQKRSTMPTMSSYLLETILLNYYSTRNNCSSYVDLELEEVFNHLSNVVYNKVNDTKGFIEDLNDLTQDERDKISNRALADRDRVQEARQLEYLEPEKAIRIWRDIFGDAFPTYGDK

SEQ ID NO: 4847 - protein, 332 aa, Unknown
  Description of Unknown: Enterobacteriaceae sequence
MALTVTAAFNEFQRNIVNLDSSQTDRARASRDWLLGRMNTFPNNDVYFPIIYPDIHTGFGSFARRTKIRPLDDIDLMFGLDGDDCVYSESDGKIIITAREGTVRLKYYKHDGTNFINSRKIINSFISSLNQIPQYDKADVKRNQEAATLKLKSYDWNFDIVPAFITTPDSFGKTYYLIPDGNGHWKKTDPRIDKQKVTDLNVKLSGNMLNVIRVIKYWQKRPTMPSMSSYLLETMLLNYFNGRSECYQWVDLEIVNVLGYLASAIFSPVYDHKGIQGNINNLSDDDKLKISIRCYLDQGKATEARNYESQNNHRASINKWQDVFGVNFPSYG

SEQ ID NO: 4848 - protein, 332 aa, Klebsiella oxytoca
MALTVTAAFNEFQRNIVNLDSSQTDRARASRDWLLGRMNTCPNNDVYFPIIYPDIHTGFGSFARRTKIRPLDDIDLMFGLDGDDCVYSESDGKIIITAREGTVRLKYYKHDGTNFINSRKIINSFISSLNQIPQYDKADVKRNQEAATLKLKSYDWNFDIVPAFITTPDSFGKTYYLIPDGNGHWKKTDPRIDKQKVTDLNVKLSGNMLNVIRVIKYWQKRPTMPSMSSYLLETMLLNYFNGRSECYQWVDLEIVNVLGYLASAIFSPVYDHKGIQGNINNLSDDDKLKISIRCYLDQGKATEARNYESQNNHRASINKWQDVFGVNFPSYG

SEQ ID NO: 4849 - protein, 332 aa, Unknown
  Description of Unknown: Enterobacteriaceae sequence
MALTVTAAFNEFQRNIVNLDSSQTDRARASRDWLLGRMNTFPNNDVYFPIIYPDIHTGFGSFARRTKIRPLDDIDLMFGLDGDDCVYSESDGKIIITAREGTVRLKYYKHDGTNFINSRKIINSFISSLNQIPQYDKADVKRNQEAATLKLKSYDWNFDIVPAFITTPDSFGKTYYLIPDGNGHWKKTDPRIDKQKVTDLNVKLSGNMLNVIRVIKYWQKRPTMPSMSSYLLETMLLNYFNGRSECYQWVDLEIVNVLGYLASAIFSPVYDHKGIQGNINNLSYDDKLKISIRCYLDQGKATEARNYESQNNHRASINKWQDVFGVNFPSYG

SEQ ID NO: 4850 - protein, 332 aa, Escherichia coli
MALTVTAAFNEFQRNIVNLDSSQTDRARASRDWLLGRMNTFPDNDVYFPIIYPDIHTGFGSFARRTKIRPLDDIDLMFGLDGDDCVYSESDGKIIITVREGTVRLKYYKHDGTNFINSRKIINSFISSLNQIPQYDKANVKRNQEAATLKLKSYDWNFDIVPAFITTPDSFGKTYYLIPDGNGHWKKTDPRIDKQKVTDLNVKLSGNMLNVIRVIKYWQKRPTMPSMSSYLLETMLLNYFNGRSECYQWVDLEIVNVLGYLASAIFSPVYDHKGIQGNINNLSDDDKLKISIRCYLDQRKATEARNYESQNNHRASINKWQDVFGVNFPSYG

SEQ ID NO: 4851 - protein, 277 aa, Klebsiella pneumoniae
HTGFGSFARRTKIRPLDDIDLMFGLDGDDCVYSESDGKIIITAREGTVRLKYYKHDGTNFINSRKIINSFISSLNQIPQYDKADVKRNQEAATLKLKSYDWNFDIVPAFITTPDSFGKTYYLIPDGNGHWKKTDPRIDKQKVTDLNVKLSGNMLNVIRVIKYWQKRPTMPSMSSYLLETMLLNYFNGRSECYQWVDLEIVNVLGYLASAIFSPVYDHKGIQGNINNLSDDDKLKISIRCYLDQGKATEARNYESQNNHRASINKWQDVFGVNFPSYG

SEQ ID NO: 4852 - protein, 332 aa, Klebsiella sp.
MALTVTAAFNDFQRNIVNLDTSQTNQARASRDWLLGRMNTFPNNDVYFPIIYPDIHTGFGSFARRTKIRPLDDIDLMFGLDGDDCVYIESDGKILITAREGTVRLKYYKHDGTNFINSRKIINSFISSLNQIPQYDKADVKRNQEAATLKLKSYDWNFDIVPAFITNPDSFGKTYYLIPDGNGHWKKTDPRIDKQKVTDLNVKLSGNMLNVIRVIKYWQKRPTMPSMSSYLLETMLLNYFNGRSECYQWVDLEIVSVLGYLASAIFSPVYDHKGIQGNINNLSDDEKLKISIRCYLDQGKATEARNYESQNNHRASINKWQDVFGVNFPSYG

SEQ ID NO: 4853 - protein, 228 aa, Klebsiella pneumoniae
MALTVTAAFNEFQRNIVNLDSSQTDRARASRDWLLGRMNTFPNNDVYFPIIYPDIHTGFGSFARRTKIRPLDDIDLMFGLDGDDCVYSESDGKIIITAREGTVRLKYYKHDGTNFINSRKIINSFISSLNQIPQYDKADVKRNQEAATLKLKSYDWNFDIVPAFITTPDSFGKTYYLIPDGNGHWKKTDPRIDKQKVTDLNVKLSGNMLNVIRVIKYWQKRPTMPSMS

SEQ ID NO: 4854 - protein, 330 aa, Alteromonas macleodii
MPTSVTGAFNAFQKETVNLDSYRTKSARSSRDWLVGKINAFDNFFPLYTDKHISFGSFARRTKIRPLDDIDMMIALTGQGCSYSEDGFGKITIHVPDDCDAYKHYRHASADSLNSIRIVNEFVRKLSNIDQYKSATIKRNQEAAVLNLKSYDWAFDIVPCFFTTEDALGRTFYIIPDGNGYWKKTDPRRDRYRVTNINTSCSGNMLNVLRLVKYWQKRPTMPSMGSYLLECMVLNYFENKGTCSQFQDMELAGVFDYIANHIFANVPDPKGIQTNLNDKLLYEEREKIYNKATADAIVAKEARNLENDGDHRASINKWRQIFGNNFPEYG

SEQ ID NO: 4855 - protein, 331 aa, Lacimicrobium alkaliphilum
MPTSVLAAFNSFQKDTVNLNPDRTKNARSSRDWLASKINAFTDFLPLYNDKHIYFGSFARRTKIRPLDDIDIMICLMGYGCTYDEDAFGRITINVPDSCDVYKNYRHAASNTLNSIRIVNEFVRKLSSIDQYKSAIIKRNQEAAVLNLKSYDWAFDIVPCFFTSEDSLSRTFYIIPDGNGHWKKTDPRKDRDRVKKINTTCSGNMLNVLRLVKYWQRRPTMPSMGSYLLECMVLNHFENKGTCSQYQDMELAGVFDDIATHIYSNVPDPKGIQTNLNDKLAFEDRIKISIKATADAVLAREARALENDGDHRASINKWRQVFGDDFPEYGS

SEQ ID NO: 4856 - protein, 333 aa, Bacteroidetes bacterium
MAKTVIEAFNKFLVDTVNLDPEQTKKARGSREWLVGQIQTFPSVDAKFPNIYIEKNVFFGSFSRSTKKRPLDDIDIMICIKADGCTYNELTDKIEITAPDTATRYKEYVNEGTSILNSRKLINAFIAKLALIPQYKKAEIKRNLEAATLNLQTYDWVFDIVPCFFTSEDAYKKTYYIIPDGNGNWKKTDPRLDSERLSKLNKTHEGNLLNVIRAVKYWNNRPTMPTMGSYLLENIILDYYSEQTTVASKYVDIEIVKVLLEIHRRVSNPVNDPKGIQGNLNNLSSEDKKKIKDRAYQDYSKAFDARQLENAKKDKDSINKWIEIFGDNFPKYE

SEQ ID NO: 4857 - protein, 333 aa, Aquiflexum balticum
MAKTVNEAFNKFLADTVNLDPDRTKKARGSRDWLVGQIERFPDSDSKFPNIYSERNIFYGSFSRRTKKRPLDDIDIMICMKADGCTYNELVDKIEITAPDAATRFKDYVNEGTSILNSRKVINAFIAKLVGIPQYKKAEIKRNLEAATLNLESYDWVFDIVPCFFTKEDAYNRTYYIIPDGSGNWKKTDPRVDSERITKINQAHEGNILNVIRAIKYWNSRATMPTMGSYLLENMILDYYAEQTTAASQYVDMEIEKVLLAIHRRVSNPVYDPKGIQGNINNLSLEDSRKIMDRAYQDYVKAFDARKLEAQNNHKDAICKWIEIFGDKFPKYE

SEQ ID NO: 4858 - protein, 166 aa, Cnuella takakiae
MALTVIEAFNKFLASEVNLDPDRTSVARSSRDWLVGKILAFPDDGNFPTIYSEMNIFFGSFARKTKIRPLNDIDIMIALKAEGANYESYYNRIEIHVPPGATRLTALCNSGTNVLNSKRIINLLKDKLKSIPQYKSAEIKRNEAACTLQLNSYEWNFDIVPCFFTQ

SEQ ID NO: 4859 - protein, 332 aa, Cnuella takakiae
MALTVIEAFNKFLASEVNLDPDRTSVARSSRDWLVGKILAFPDDGNFPTIYSEMNIFFGSFARKTKIRPLNDIDIMIALKAEGANYESYYNRIEIHVPPGATRLTALCNSGTNVLNSKRIINLLKDKLKSIPQYKSAEIKRNEAACTLQLNSYEWNFDIVPCFFTQQEFDGKTYYLIPDGNGNWKKTDPRVDRDFVASLNQRHDGNLLNIIRAVKYWQRRPTMPTMQSYLLETMLLHAYNNTSGKASQFIDMNLSGVFSYISQNIHYPVQDIKGISGDLNDVDYFDRSKIANRAREDAEKASRARTAEINKDMKESIKLWGEIFGPNFPSYG

SEQ ID NO: 4860 - protein, 334 aa, Desulfomonile tiedjei
MATSVTSAFNQFMQNVVNLDPEETKSARKSRDWLVKQIRSFPEAEGSFPRLYSEKDIFFGSFARMTKIRPLDDIDMMICLHAQGSVYAESWGHCDITIRSAGSNLGPLCNDGTFTLNSRKVINKFVSHLSSVPQYKNAAIKRNLEAAVLNLTSYMWSFDIVPCFFTEPDAWGRTYYLIPDGNGAWKKSDPRNDRDRVTRVNQTHKGNILNVIRIMKYWNRRPTMPSMASYLLETMIVDHYDNVWCSEASSYVDLEIPKVLAHIANSLFSSVNDPTGVQGDINTLSHQDRQKIWSRANYDHQRALEARQLEDQGNQHASIAKWGEIFGSSFPDYG

SEQ ID NO: 4861 - protein, 334 aa, Anabaena sp.
MAKTVNAAFEEFLEDYVNLDPQDTKKARSSRNWLIEEQIHSFPYKDLYFPRLYSEKDIYFGSFARRTKKRPLDDIDIMIALSAEGSTYYGFSNDFIEMYVPNSAYKLKKLCSDGTNKLNSIKVINKFIALLDKVPQYQPADKHRNQEAGTLKLKSYDWNFDIVPCFLTAPEYTGRTYYLIPDGKGNWKKTDPRIDRDRVTQVNQYHDGNILNLIRLMKYWNKRPTMPSMGSYLLENMILDFYSITRVRASSYIQWEISKLLEYINHNIFNSVNDPKLIQGNINTLEYTDKIKIANRSSKDYLKSLDAIELENNGYHTLAINTWGEIFGNNFPVY

SEQ ID NO: 4862 - protein, 337 aa, Anabaena sp.
MAKTVNAAFEEFLKDYINLDPQDTEKARSSRDWLIIEQIHSFPERNLYFPTLYSEKDIYFGSFARRTKKRPLDDIDIMIALSAEGSTYYEYSSDFIEIYVPDSAYKLKKLCADGTNKLNSIKIINKFIALLDKVPQYQPADKHRNKEAATLKLKSYDWNFDIVPCFFTAPGYTGRTYYLIPDGKGNWKKTDPRIDRDRVTQVNQTHDGNILNIIRLMKYWNKRPTMPSMDSYLLENMILDFYSINIHSKASRYIALEMPRLFQYIQTNIFYQVNDPKLIQGNINNLDLQDKRKISSRAFQDYLKSLYALELDEKGYSTSAINTWREIFGNNFPVSVY

SEQ ID NO: 4863 - protein, 297 aa, Anabaena sp.
MAQTVNVAFDEFLKDYVNLDIKDTAKARNSRDWLIEEQIHSFPYKDLYFPRFYSEKDIYFGSFARRTKKRPLDDIDIMIALSAEGSTYYEYTNGVIEMYVPDSAYKLKMLCNDDTNTLNSRKILNKFKYLLSKVPQYQEADIKTNLEAVTLKLKSYTWNFDIVPCFFTNPELSGRTYYLIPDGKGNWKKTDPRIDRYRVTEVNQAHNGNVLNVIRLMKFWNKRQTMPSMGSWQQVINRRIPSQELERESYILQNQIYDNRRLSPLIFDWLYSRLKKQNEEQMNKGAEVLIKELLQTP

SEQ ID NO: 4864 - protein, 333 aa, Alkalinema sp.
MVKTVNEAFSIFLRDYVNLDPHETQRARSSRDWLLSQIHLFSDKDTNFPRLYSEKDISFGSFARRTKKRPLDDIDMMIVLSAESGIYHEFTDRIEIYVSESAYKLKALCFDNTTTLSSRKVINKFISLLKQVPQYEKADIKRNMEAATLNLKSYPWTFDLVPCFFTQKDWLNRDYYLIPDGQGHWKKTDPRIDRQRVNDINQLHDGNVLSVIRLMKYWNRRPTMPSIYSYLIENMILDFYSTQYTKASGYVDLEVPKVLQYIQSSIFHPVNDPKGMQGNINHLSREEQDKISKRAYSDYLRSLEARALEEKGEHKLSIAKWSEIFGWNFPAYT

SEQ ID NO: 4865 - protein, 333 aa, Leptolyngbya sp.
MVKTVNEAFSVFLRDYVNLDPDETQRARSSRDWLLSQIHLFPDKDANFPRLYSEKDIFFGSFARRTKKRPLDDIDMMIALSAESGVYHEFADRIEIYVSESAYKLKALCFDNTTTLSSRKVINKFVSLLKQVPQYEKADIKRNMEAATLNLKSYPWTFDLVPCFFTQKDWLNRDYYLIPDGQGHWKKTDPRIDRKRVNDINQLHDGNVLNVIRLMKYWNRRPTMPSMSSYLIENMILDFYSTQHMKASGYVDLEVPKVLQYIQASIFYQVNDPKGIQGNINQLSREEQDKISKSAYSDYLKSLEARALEEKGEHKLSIAKWSEVFGLNFPIYA

SEQ ID NO: 4866 - protein, 345 aa, Paenibacillus polymyxa
MNYKEIKNKEGKMATTVNTAFSEFMRDTVNLDSEVTKTARRSRDWLIGQIDKFDSKIGFPTLYNDIDIHFGSFARKTKIRELNDIDLIIGLRSQGSTYLQDSWGRIEMTVPDTATDLMKLCHDYTNKLNSRKVINKFISELSTIPQYKKAEIKRNLEAATLELTTHPWNFDIVPSFITVPESDGRTYYIIPDGKGHWKKTDPRLDRSNISRINQKHNGKILNVIRLIKYWNNRPTMPSMGSYLLECMLLSYYDNKDTVSDFVDIEARNIFAHISSAIYNNVYDPKNIQGNLNNLSFDEKQKISAKAHFDHRNALEASQFEGDGDHKSAIIKWRGIFGSAFPEYTQ

SEQ ID NO: 4867 - protein, 333 aa, Paenibacillus polymyxa
MATTVNTAFSEFMRDTVNLDSEVTKTARRSRDWLIGQIDKFDSKIGFPTLYNDIDIHFGSFARKTKIRELNDIDLIIGLRSQGSTYLQDSWGRIEMTVPDTATDLMKLCHDYTNKLNSRKVINKFISELSTIPQYKKAEIKRNLEAATLELTTHPWNFDIVPSFITVPESDGRTYYIIPDGKGHWKKTDPRLDRSNISRINQKHNGKILNVIRLIKYWNNRPTMPSMGSYLLECMLLSYYDNKDTVSDFVDIEARNIFAHISSAIYNNVYDPKNIQGNLNNLSFDEKQKISAKAHFDHRNALEASQFEGDGDHKSAIIKWRGIFGSAFPEYTQ

SEQ ID NO: 4868 - protein, 334 aa, Paenibacillus sp.
MATTVNTAFNEFMKNTVNLDSEITSTARKSRDWLLDQIDNFGSKEGFPSLYSDVDIHFGSFARKTKIRELDDIDLMIGLSAQGSTYLEDYFGKIEITVADAATNLLSLTHENSTKLNSRKVINKFVSELKTISQYKSAEIKRNQEAATLELKTYDWTFDIVPCFMTSAENDGRSFYLIPDGNGHWKKTDPRIDRDNITNVNQKHNGKVLNAIRLMKYWNRRATMPTIGSYLLESIILAYYDSKLIVTEYIDLELRDLLHHISSAIYNDINDPKNIQGNLNLLTFEDKQKIASKALVDYDKAVEAINFETTSGDHKSSINKWREILGSQFPTYTG

SEQ ID NO: 4869 - protein, 333 aa, Saccharibacillus sacchari
MATTVNSAFNEFMRDYVNLDSNVTASARSSRNWLIQQIDKFDQQDGFPTLYSDIDIHFGSFARKTKIRELDDIDLMFGLSAQQSTYLEYSSGKVEITVPDSAIGLYPLCHDYTDKLNSRKVINKFVASLKGISQYENADIKRNQEAATLKLRTYSWVFDIVPCFITASDSLGKDYYLIPDGNGHWKKTDPRIDKANISRINKKHDGNVLNVIRLMKYWNRKASMPTMGSYLLECLLLSYLDTRGSVSSYIDLTIPDVLLHIHTAIFNAVADPKNIQGNLNNLSYEDKQKISSKAYSDYTKAIEARKAEDEKDHASSIKKWGEIFGGNFPKYTG

SEQ ID NO: 4870 - protein, 334 aa, Unknown
  Description of Unknown: Citrobacter sequence
MSYQVSTAFNSFMNNFVNLDANDTREGRKSRDWLVDEQLLKFPGQDETFPLLSNAPKMWFGSFSRRTKIRELDDIDMMIIMHAQGSTYYDYGSTVNLSPGQNSRFLNYLDDSGQWINSRKVVNKFVSSLKEVPQYSKADSKRQGEAATLKLLTRSWNFDIVPAFITSPEADGTTFYLIPDGAGHWKKTDPRIDKDRTTRLNQKHDGNVLNAIRLVKYWKRKRGVPTIGSYLLETILLNRYEHLIQGGMSEWVDNEFPQALRALASAILGPVYDQKDFQGDINNLSSDDRWKVWEKATTDASLAEQALAVEFSDPVESGKLWQRVLGSDFPADAS

SEQ ID NO: 4871 - protein, 334 aa, Cronobacter turicensis
MSYQVSTAFNSLMNNFVNLDADETRNGRRSRDWLVDEQLTKFPDKDDEFPLLSTTPKMWFGSFSRRTKIRELDDIDMMIVMHAEGSTYTQSGKTFYISPGTNSRFQNYLNETGEWVNSRRVVNKFVSSLKSVSQYSSADSKRQGEAATLNLKSYSWNFDIVPAFITTPDSYGNTFYLIPDGSGNWKQTDPRIDKNRATRVNQKHNGKVLNVIRLVKYWKRKRGVPAIGSYLLETIMLNHYDDLNKDSMSEYLAIEFADALQALATAIVGYVGDQKNFQGDINHLSSEEQKKVQEMAFEDANNAKEALSIEFTDPEKSGKIWQKVLGKDFPVGNA

SEQ ID NO: 4872 - protein, 334 aa, Morganella morganii
MPYQVSTAFDSLMNNFVNLDADDTRNGRRSRDWLVDEQLTSFPDKDDKFPLLSSTPKMWFGSFSRRTKIRELDDIDMMIVMHAEGSTYTQSGKTFYITPGTNSRFQNYLNETGEWVNSRRIVNKFVSSLKSVPQYSAADSKRQGEAATLNLKSYTWNFDIVPAFITAPDSYGNTFYLIPDGNGNWKQTDPRIDKDRATRVNQKHNGKVLNVIRLVKYWKRKRGVPAIGSYLLETIMLNHYDELNKDSMSEYLDVEFSNALQVLATAIVGYVGDQKKFQGDINHLSSEEQKKVQEMALEDANNAKEALSIEFSDPEKSGKLWQKVLGKDFPVGNA

SEQ ID NO: 4873 - protein, 334 aa, Trabulsiella odontotermitis
MAYQVSTAFNSLMNNFVNLDADETRKGRRSRDWLVDEQLTRFPDKDDEFPLLSTTPKMWFGSFSRRTKIRELDDIDMMIVMHAEGSTYTQSGKTFYISPGTNSRFQNYLNETGAWVNSRRVVNKFVSSLKSVPQYSSADSKRQGEAATLNLKSYTWNFDIVPAFITSPDSYGNTFYLIPDGSGNWKQTDPRIDKDRATRVNQKHSGKVLNVIRLVKYWKRKRGVPAIGSYLLETIMLNHYDELNKDSMSEYLDIEFADALQVLATAIVGYVGDQKNFQGDINHLSSEEQKKVQEMALDDANKAKEALSIEFTDPEKSGKIWQNVLGKYFPVGNV

SEQ ID NO: 4874 - protein, 334 aa, Salmonella enterica
MPYQVSTAFNSLMNNFVNLDADETRNGRRSRDWLVDEQLTRFPDKDDEFPLLSTTPKMWFGSFSRRTKIRELDDIDMMIVMHAEGSTYTQSGKTFYISPGANSRFQNYLNETGEWVNSRRVVNKFVSSLKSVPQYSAADSKRQGEAATLNLKSYTWNFDIVPAFLTKPDTNGNTFYLIPDGNGNWKQTDPRIDKDRATRVNQKHNGNVLNVIRLVKYWKRKRGVPAIGSYLLETIMLNYYDKLAKDSMSGSLGIEFADALQVLASAIVGYVGDQKNFQGDINHLSSEEQKKVREMALEDANNAKEALSIEFTDPEKSGKIWQKVLGKDFPVGNV

SEQ ID NO: 4875 - protein, 288 aa, Salmonella enterica
MPYQVSTAFNSLMNNFVNLDADETRNGRRSRDWLVDEQLTRFPDKDDEFPLLSTTPKMWFGSFSRRTKIRELDDIDMMIVMHAEGSTYTQSGKTFYISPGANSRFQNYLNETGEWVNSRRVVNKFVSSLKSVPQYSAADSKRQGEAATLNLKSYTWNFDIVPAFLTKPDTNGNTFYLIPDGNGNWKQTDPRIDKDRATRVNQKHNGNVLNVIRLVKYWKRKRGVPAIGSYLLETIMLNYYDKLAKDSMSGSLGIEFADALQVLASAIVGYVGDQKNFQGDINHLSSEE

SEQ ID NO: 4876 - protein, 334 aa, Klebsiella pneumoniae
MPYQVSTAFNSLMNNFVNLDADETRNGRRSRDWLVDEQLTGFPDKDDEFPLLSTTPKMWFGSFSRRTKIRELDDIDMMIVMHAEGSTYTQSGKTFYISPGANSRFQNYLNETGEWVNSRRVVNKFVSSLKSVPQYSAADSKRQGEAATLNLKSYTWNFDIVPAFLTKPDSNGNTFYLIPDGNGNWKQTDPRIDKDRATRVNQKHNGNVLNVIRLVKYWKRKRGVPAIGSYLLETIMLNYYDELAKDSMSESLGIEFAGALQVLASAIVGYVEDQKNFQGDINHLSSEEQKKVREMALEDANNAKEALSIEFTDPEKSGKIWQKVLGKDFPVGNV

SEQ ID NO: 4877 - protein, 334 aa, Klebsiella aerogenes
MPYQVSTAFNSLMNNFVNLDADETRNGRRSRDWLVDEQLTGFPDKDDEFPLLSTTPKMWFGSFSRRTKIRELDDIDMMIVMHAEGSTYTQSGKTFYISPGANSRFQNYLNETGEWVNSRRVVNKFVSSLKSVPQYSAADSKRQGEAATLNLKSYTWNFDIVPAFLTKPDSNGNTFYLIPDGNGNWKQTDPRIDKDRATRVNQKHNGNVLNVIRLVKYWKRKRGVPAIGSYLLETIMLNYYDELAKDSMSESLGIEFADALQVLASAIVGYVEDQKNFQGDINHLSSEEQKKVREMALEDANNAKEALSIEFTDPEKSGKIWQKVLGKDFPVGNV

SEQ ID NO: 4878 - protein, 334 aa, Klebsiella pneumoniae
MPYQVSTAFNSLMNNFVNLDADETRNGRRSRDWLVDEQLTVFPDKDDEFPLLSTTPKMWFGSFSRRTKIRELDDIDMMIVMHAEGSTYTQSGKTFYISPGANSRFQNYLNETGEWVNSRRVVNKFVSSLKSVPQYSAADSKRQGEAATLNLKSYTWNFDIVPAFLTKPDSNGNTFYLIPDGNGNWKQTDPRIDKDRATRVNQKHNGNVLNVIRLVKYWKRKRGVPAIGSYLLETIMLNYYDELAKDSMSESLGIEFADALQVLASAIVGYVEDQKNFQGDINHLSSEEQKKVREMALEDANNAKEALSIECTDPERSGKIWQKVLGKDFPVGNV

SEQ ID NO: 4879 - protein, 334 aa, Hafnia alvei
MPYQVSTAFNSLMNNFVNLDADETRSGRRSRDWLVDEQLTSFPDKDDKFPLLSSTPKMWFGSFSRRTKIRELDDIDMMIVMHAEGSTYTQIGNTFFISPGANSRFQNYLNDTNEWVNSRRIVNKFVSCLKSVPQYAAADSKRQGEAATLNLKSYTWNFDIVPAFITKSDSYGNSFYLIPDGNGNWKQTDPRIDKDRATAVNQKHSGKVLNVIRLVKYWKRKRGVPAIGSYLLETIMLNHYDALAKDSMSEYLDVEFSDALQALASAIVGYVGDQKNFQGDINNLSSEEQEKVREMALEDANNAKEALSIEFDDPEKSGKIWQKVLGKDFPVGDA

SEQ ID NO: 4880 - protein, 334 aa, Rahnella aquatilis
MAYSVNAAFNTLMKEFVNLDSEDSQAGKKSRDWLVDRQILNFPEKDNKFPLLYPEPKMWFGSFSRKTKIRELDDIDLMIIMHAEQSYYTQIDNTFYITPGDGSRYKNYTDDGGNYINSRRVVNKFVNSLSDVWQYTSAESKRQGEAATLKLKSYAWNFDIVPAFMTAPDAYGQTFYLIPDGYGNWKKTDPRIDKERTTRLNQKHGGKMLNVIRLVKYWKRKRGVPSIGSYLLETILLNRYDNLYQDGIHEWVDEEFPRVLRDLASSILNPVYDHKNIQGDINVLTRDERWKVWEKATADAGVADEAISLEFSDPQASGRLWQKVLGTDFQVVDA

SEQ ID NO: 4881 - protein, 334 aa, Pantoea vagans
MAYSVNAAFNTLIKDFVNLDPETSRSGKVSRNWLVDKQITNFPVNDEKFPLLYSEPKMWFGSFSRKTKIRELDDIDLMIIMHAEQSFYSQIANTFFISPGANSRYLNYTDSSGSYINSRRVVNKFVSSLSTVWQYASADTKRQGEAATLKLKSYSWNFDIVPAFMTAPDERGETFYLIPDGDGNWKRTDPRIDKERTTRLNQKHAAKMLNVIRLVKYWKRKRAVPAINSYVLETIILNYYDVLFEGSIREYIDEEFPHVLRNLALAVLHPVYDHKNIQGDINGLTWDERLKIHEKATSDASLAEEAVALKFSDPVRSGKLWQQVLGRDFPVAEA

SEQ ID NO: 4882 - protein, 329 aa, Paenibacillus sp.
MARTVITAFDDFQKNVINLDSEVTNMARKSRDWLMKQINDFPIKDITFPELYSEKNIYSGSFARKTKIRELDDIDLMIAFSAAYGSYYEIYYDHVKIFVTDNKLSAFCNDGTNVLNSRKIINKIISRLRQVSQYGSANVKRNQEAVTLKLATYIWNFDIVPCFFTQKDHYDKDYYLIPDGDGNWKKTDPRIDAKRSSIINQYHDGNVLNVIRIIKFWNTRPTMPSIPSYLLENMILNYYENNSSKASPYVDIEIEKILGHISIVIFYDLDDPKGIQGDLNKLSYAEKLKISNRANIDYQKAIEARNFESNGENERSIRKWKEIFGPSFY

SEQ ID NO: 4883 - protein, 332 aa, Gracilibacillus orientalis
MVSVNAAFNYFLKNEVNLDHDKTTTARKSRDWLINRISKFPSEDTSFPKGYSEINIFFGSFARRTKIRELDDIDLMIGLSGEGAHYVAHNDYVEIIVDDNTNNLSSLCFDDTNALNSRKVINKYIGNLKNIENYKKAEMKRNKEAANLKLSSYEWNFDIVPCFITAKDTSDKNYYLIPNGEGNWKFTDPRIDRERTKSINQSNDGNVLNTIRIMKYWNKHAKMPTISSYLLETIILNYYSSNFNKASELVDLNIPNILSYISDSIHFAVQDPKNIQGNINELNSEDRTKIGEKANADYQIALEARSLESVNKHEESIRKWEKIFGSRFTVNV

SEQ ID NO: 4884 - protein, 333 aa, Staphylococcus epidermidis
MVKTVEAAFEKFLKDYVNLDKVETDRARKSRDWLVNQQIKIFPDKEETFPNLYNEKSIYFGSFARKTKIKELDDIDIMIALSAENGSYVEYLDKVEIIVEENANMLRKLCFDNSNKLNSRKVINKFIELLNKIPQYEYSEIKRNQEAATLKLSSYKWNFDIVPCFFTKKDLNGDTRYLIPDGNGNWKKTDPRIEKSIISELNQINDGKLLDVIRVIKYWNRNSMAPTVSSYLLEVIILNYYQDNNKLNQNISLEIPNVLDHIQKTIYNMIFSPDNPGVNINNLTQEEKDKISRKAIEHFEISQNAINFAASFKYEKAINEWRKVFGKNFPLYD

SEQ ID NO: 4885 - protein, 333 aa, Staphylococcus haemolyticus
MVKTVEAAFEKFLKDYVNLDKVETDRARKSRDWLVNQQIKIFPDKEETFPNLYNEKSIYFGSFARKTKIKELDDIDIMIALSAENGSYVEYLDKVEIIVEENANMLRKLCFDNSNKLNSRKVINKFIELLNKIPQYEYSEIKRNQEAATLKLSSYKWNFDIVPCFFTKKDLNGDTRYLIPDGNGNWKKTDPRIEKSIISELNQINDGKLLDVIRVIKYWNRNSMAPTVPSYLLEVIILNYYQDNNKLNPNISLEIPNVLDHIQKTIYNMIFSPDNPGVNINNLTQEEKDKISRKAIEHFEVSQNAINFAASFKYEKAINEWRKVFGKNFPLYD

SEQ ID NO: 4886 - protein, 332 aa, Unknown
  Description of Unknown: Staphylococcus sequence
MVKTVEAAFEKFSKDYVKLDRNETNKALKSRDWLVQQIKTFPNKEKTFPNLYSEKNIYFGSFARKTKIKDLDDIDIMITLSAENGTYIEYSDKIEIIVEENADMLKKLCFDDSNRLNSRRVINKFIELLKKIPQYEYSDIKRNQEAATLKLATYKWNFDIVPCFFTKKDLKGNTHYLIPDGNGYWKKTDPRIEKSIISELNQINGGKLLDIIRIIKYWNKNSMAPTMPSYLLEIIILNYYQDNKELKQHISTEIPNILNFIQKEIYNMIFSPDNPKVDINTLSQEEKYKISQKANEHSKISQKAIDFASNLDNKKAIDEWRKVFGKEFPLYV

SEQ ID NO: 4887 - protein, 332 aa, Staphylococcus aureus
MVKTVEAAFEKFSKDYVKLDRNETDKALKSRDWLVQQIKTFPNKEKTFPNLYSEKNMYFGSFARKTKIKDLDDIDIMITLSAESGSYIEYSDKIEIIVEENADILKKLCFEDSNRLNSRKVINKFIELLNKIPQYEYSDIKRNQEAATLKLATYKWNFDIVPCFFTKKDLNGNTHYLIPDGNGYWKKTDPRIEKSIISELNQINGGKLLDIIRIIKYWNKNSIAPTMPSYLLEIIILNYYQDNNKLKQHISTEIYNILNFIKKEIYNMIFSPDNPKVDINILSQEEKYKISQKANEHSKISQNAINFASNLDNKKAIDEWRKIFGKEFSLYV

SEQ ID NO: 4888 - protein, 333 aa, Staphylococcus hominis
MVKTVEAAFEKFLKDYVRLDRIETDKALKSRDWLVEQQIKIFPDKEETFPNLYIEKNIYFGSFARKTKIKYLDDIDIMIALNAENGSYIEYLDKIEIIVDENANMLRKLCFDDSNKLNSRKVINKFIELLNKIPQYEYAEIKRNHEAATLKLSSYKWNFDIVPCFFTKKDLNGDTHYLIPDGNGNWKKTDPRIEKSIISDLNQINGGKLLDVIRIIKYWNKNSMAPTMPSYLLEVIILNYYQDNKRIKQHINLEIPNVLNFIQEEIYNMIFSPDNPEVDINILTQEEKYKISQKAIEHSKISQNAINFALNLDDEKAIDEWRKVFGKDFPLYG

SEQ ID NO: 4889 - protein, 331 aa, Vibrio splendidus
MPKTINAAFECFMRDEVNLPNGKPTRARTSRDWLLDKLNTFGEQQNNFPKLYTSKHMPFGSFARNTKKRPLDDVDILLCMSANGVTYSEIGNTVYMTALEGAYPFNQLCSDTSGYVSSIKVLNRVKSYLNQVPQYDKADIKRDGQAMTMKLSSYDWNFDIVPCFHTTPESDGRQYYIMPDGSGNWMKTDPARDQHYSTSVNQANDGNVLSIIRLVKYWNKRGSMVNAPSYLLENLVLNYYENNSAGKWPDLELPQVLQYISNAVYQRVVDQKGLLWDINTLSQEQRDSISNKAHSHSELGATAIQNENTNTAYAFSLWKRILGSDFPDYEA

SEQ ID NO: 4890 - protein, 275 aa, Vibrio campbellii
MPKTINAAFDCFMRDEVNLPNGKPTRARTSRDWLLDKLNTFGEQQNNFPKLYTSKHMPFGSFARNTKKRPLDDVDILLCMNANGVTYSEIGNTVYMTAPEGAYPFNQLCSDTSGYVSSIKVLNRVKSYLNQVPQYDKADIKRDGQAMTMKLSSYDWNFDIVPCFHTTPESDGRQYYIMPDGSGNWMKTDPARDQHYSTSVNQANDGNVLSIIRLVKYWNKRGSMVNAPSYLLENLVLNYYENNSAGKWPDLELPQVLQYISNAVYQRVVDQNVVA

SEQ ID NO: 4891 - protein, 331 aa, Vibrio alginolyticus
MPKSINSAFKTFMKDKVNLPTGKPTKARASRDWLITNLNSFGVQENDFPALFTEKHMPFGSFARNTKKRPLDDIDLLLCMKANGVTYSDIGGTVYMISPETAAPFNKLLSDTTGYVSSIKVLNKVKSYLQNIPQYDQSDIKRDNQAMTMKLKTYDWNFDIVPCFYTAPEPDGREYYIMPDGNGNWMKTDPKRDQDYSTKINQDNNGNVLSIIRLVKYWNSRKCMLSAPSYLLENLVLNYYEHHVATEWPDVELPQVLGYISNAIYGRVVDQKGLSWDINTLNEDEQHSISQKALEHSHLGYTAREYEYSNTAYAFSLWQKILGSEFPDYEA

SEQ ID NO: 4892 - protein, 331 aa, Vibrio sp.
MSDFRINKSINAFVADHIDLHKDTVQKGRNSRNWLLDQLESMAQKVEHFPPRYTDRHKGFGSFHRSTKKQPLDDIDQLFCFSARGDMHYSEVGSTVYINIAGDNEIYGHLTSTNDNTKLSSIKMVNLMVSSLDSIGQYKNTPHRNGEAATLQAAAYDWNFDIVPCFFTAADANGKDYYLIPDGSGNWKKTDPREDKNRSARINQSHRGQILQLIRIIKYWNKRQTMATMGSYLLENMVLDYFENNKPSEEYIEFSIRAIFDYIANAVYFPVNDPKGIQGNLNNLDFDKMKSISERAKLDSLRLHNADQYEFSNPDKAINELKAIFGSDFVG

SEQ ID NO: 4893 - protein, 334 aa, Vibrio harveyi
MSNFRINDAIKVFVSDHIDLKKDTVDKGRGSRDWLLEQLESMAKKTTNFPPRYPKKHKGFGSFHRSTKKRPLDDIDQLFCFSARGDMYYSEEGSTVYINMDSDNETYKHLASTHDNTKISSIKMVNLMVTSLDNIGQYKNTPHRNGEAATLQASAYDWNFDIVPCFFTAADSQGKDYYLIPDGKGNWKKTDPREDKARSSRVNQSHDGKILQLVRIIKYWNKRQTMSTMGSYLLENMVLDYFETYSPSSIYIEHSIRDLFDYIAQAVYLPVSDPKGIQGDLNNLDWDSKNSISARAKLDSERLKTADQYEFENPARAIKELKAIFGDSFTGEVS

SEQ ID NO: 4894 - protein, 331 aa, Aliivibrio fischeri
MATQLSSAINEFLRTHVNLDSNQVKQGRASRDWLLEQLESIATKNAIFPPRFGGQHRGFGSFRRSTKKQPLDDIDQMFCFSSHGDMHYSEVGSTVYINVGEDNLVYKRYVSSQDSTKLSSIRIVNLIVNSLNQIPQYSNSASRNSEAATLKATSYPWNFDIVPCFMTSEDASGNTYYLIPDGYGNWKKTDPRKDTERSSTVNQNNDKKVLQIVRLMKYWNKRPTMATMTSYLLENMILDYYEANSVNSYIDWDIKAVLRYISNNIFSVVQDPKGIQGNLNVLTYEQQVSIQKRANDDIARLQEAGNYEFEDPKRAINLWRIVFGNNFPTYG

SEQ ID NO: 4895 - protein, 322 aa, Lactobacillus acetotolerans
MSKTVNSAFRAFLDDEVNLDPDLNKKARNSRDYLLANIAEFGKVTDFFDLYSGFNLYYGSFAGKTKKKPLDDIDLMVGFSGDGYVYHKEEDHFLISVNDKNKEYGCTDDGYLNSRKVIELLKSRLYQISNYQKADVHRNMQAITLQLSSYPWNFDMVPCFYTDAGFYLIPNGYGKWEKTDPRIDNKRTTRINQKFDGHLLELIRLVKYLNSRKLTITIPSYLLEVIILNYYGRQYFNGNWEIDDNLKLVFGEIATEILGSVIDPKGIQGNINTLEWEDRLKISTFFDKIAKEAGNAVLQRIIGNEQVAIEIWSSIFGEQFKK

SEQ ID NO: 4896 - protein, 322 aa, Lactobacillus acetotolerans; identical to SEQ ID NO: 4895

SEQ ID NO: 4897 - protein, 322 aa, Unknown
  Description of Unknown: Lactobacillus sequence
MSKTVNSAFRAFLDDEVNLDPDLNKKARNSRDYLLANIAEFGKATDFFDLYSGFNLYYGSFARKTKKNPLDDIDLMVGFSGDGYVYHKEEDHFLILVNDKNKEYGCTDDGYLNSRKVIELLKSRLYQISNYQKADVHRNMQAITLQLSSYPWNFDIVPCFYTDAGFYLIPNGYGKWEKTDPRIDNKRTTRINQKFYGHLLELIRLVKYLNSRKLTITIPSYLLEVIILNYYDRQYFNGNWEIDDNLKLVFGEIATEILGSVIDPKGIQGNINTLAGEDRLKISTFFDKIAKEAGNAVLQRIIGNEQAAIEIWSSIFGEQFKK

SEQ ID NO: 4898 - protein, 322 aa, Lactobacillus johnsonii
MSKTVNSAFRAFLDDEVNLDPDLNKKARNSRDYLLANIAEFGKATDFFDLYSGFNLYYGSFARKTKKNPLDDIDLMVGFSGDGYVYHKEEDHFLILVNDKNKEYGCTDDGYLNSRKVIELLKSRLYQISNYQKADVHRNMQAITLQLSSYPWNFDIVPCFYTDAGFYLIPNGYGKWEKTDPRIDNKRTTRINQKFYGHLLELIRLVKYLNSRKLTITIPSYLLEVIILNYYDRQYFNGNWKIDDNLKLVFGEIATEILGSVIDPKGIQGNINTLAGEDRLKISTFFDKIAKEAGNAVLQRIIGNEQAAIEIWSSIFGEQFKK

SEQ ID NO: 4899 - protein, 329 aa, Shewanella xiamenensis
MAMTVNTAFTDFLKNTVNLDPTRTATARASRDNLKIQIAKFEDFFPLYGAMDIDFGSFARKTKIRPLDDIDMIFTLSANGCTWHETYDGVVYIYTPTDSPEYSDYLHDNSYRLNSRKVINEFIRNLSSLNHYSKADLHRNQNAATLKLTSYDWNFDIVPAFFTTEDSAGNTYYIIPDGNGNWMKTDPRIDRQRVIDINQMCNGYVLNTIRAIKYWQRRATMPSMPSYLLENMVLNYFENKGEASQFVDINVINVLQYIKNNIWSNVNDPKGIQGNLNTLSWDDQNKISQKAETDFNTALAAREFEKEKDHQKAIGEWRKVFGNDFPQYG

SEQ ID NO: 4900 - protein, 329 aa, Shewanella sp.
MSTTVNAAFNAFMSNTVNLDGSRTNTARSSRDFLKGKISGLEDFFPLYGDKNIDFGSFARRTKIKPLDDIDMIFTLSANGCTWEETFDGIVYITTSADSPEYKDYRHDNSYRLNSRKVINRFVSNLSDLNHYEKAELHRNQNAATLKLTSYDWNFDIVPAFFTTEDSAGKTYYIIPDGKGNWMKTDPRLDRQRVTDINQLCNGHVLNAIRAIKYWQRRSTMPSMSSYLLESMVLNHFEVKGEATEFIDINVINILGYIKNNIWSSVDDPKGIQGNLNTLTYDDKLKISQKAETDFNTALAAREFESVGDHEKAIGEWRRVYGTEFPQYG

SEQ ID NO: 4901 - protein, 329 aa, Vibrio jasicida
MPTTVNSAFNQFMSDKVNLDSKKTTTARSSRDYLKGQVKGLTDFFPLYSDKDINFGSFARRTKIRPLDDIDMIFTLSANGCTWEESFDGTIYINTPTESPEYKSFRHDSSFRLNSRKVINHFVSKLTELNHYSKAELHRNQNAATLKLTSYDWNFDIVPAFFTTEDADGKTFYIIPDGNGHWIKTDPRLDRQRVTDINQQCGGHVLNAIRAIKYWQRRATMPSMPSYLLENLVLNYFAEKGEASLFVDINIINVLQYIKDNIWWNVNDPKGIQGNLNTLSWDEKTKISRKAETDFNTALAAREFEKEEDHKKAIGEWRKVFGNDFPQYG

SEQ ID NO: 4902 - protein, 329 aa, Vibrio vulnificus
MPTTVNSAFNQFMTDKVNLDSKKTTTARSSRDYLKGQVKGLTDFFPLYSDKDINFGSFARRTKIRPLDDIDMIFTLSANGCTWEQSFDGTVYINTPTESPEYKSFRHDSSFRLNSRKVINHFVSKLTELNHYSKAELHRNQNAATLKLTSYDWNFDIVPAFFTTEDADGKTFYIIPDGNGHWIKTDPRLDRQRVTDINQQCGGHVLNTIRAIKYWQRRATMPSMPSYLLENLVLNYFAEKGEASLFVDLNIINVLAYIKDNIWLNVDDPKGIQGNLNTLSWDEKTKISQKAETDFNIALAAREFEKEEDHKKAIGEWRKVFGNDFPQYG

SEQ ID NO: 4903 - protein, 329 aa, Vibrio parahaemolyticus
MPTTVNSAFNQFMADNVNIDSKKTTTARSSRDYLKEQVKGLTDFFPLYSDKDINFGSFARRTKIRPLDDIDMIFTLSAHGCTWEESFDGTVYINTPTESPEYKSFRHDSSFRLNSRKVINHFVSKLTELNHYSKAELHRNQNAATLKLTSYDWNFDIVPAFFTTEDADGKTFYIIPDGNGHWIKTDPRLDSQRVTDINQQCGGHVLNAIRAIKYWQRRSTMPSMSSYLLENLVLNYFAEKGKASQFVDINIINVLQYIKDNIWWSVNDPKGIQGNLNTLSWDEKTKISRKAETDFNTALAAREFEKEEDHKKAIGEWRKVFGNDFPQYG

SEQ ID NO: 4904 - protein, 335 aa, Clostridium sp.
MKRGGLILATTVDQAFIEFLKDKVNLDPNITTKARSSRDNLIENIKGFSGDDDFFTTYNDRILKFGSFAKKTKIRELDDIDMMFCLSADGRTYTELTDGFEINGVQADKDNSLCIDDTYKLNSTKVINRFISKLEELNDYKKSDMKKNHEAATLQLKSYTWNFDIVPCFYTTSDIYLIPDGKGNWKKTDPRIDADNVSTINQKHKGKVLNVIRLTKYWNRYNSTVTITSYLLETMILNYYNNLIESENYWVDLEFKNVLQYLSNEILNDVADPKGIQGNINLFSIDDRLKISKKAKDCYDKACEASTSELTDKDQESAINKWGEILGDEFPKYEE

SEQ ID NO: 4905 - protein, 328 aa, Unknown
  Description of Unknown: Clostridium sequence
MATTVDQAFIEFLKDKVNLDPNITTKARSSRDNLIENIKGFSGDDDFFTTYNDRILKFGSFAKKTKIRELDDIDMMFCLSADGRTYTELTDGFEINGVQADKDNSLCIDDTYKLNSTKVINRFISKLEELNDYKKSDMKKNHEAATLQLKSYTWNFDIVPCFYTTSDIYLIPDGKGNWKKTDPRIDADNVSTINQKHKGKVLNVIRLTKYWNRYNSTVTITSYLLETMILNYYNNLIESENYWVDLEFKNVLQYLSNEILNDVADPKGIQGNINLFSIDDRLKISKKAKDCYDKACEASTSELTDKDQESAINKWGEILGDEFPKYEE

SEQ ID NO: 4906 - protein, 331 aa, Dorea sp.
MATTVNGAFTEFMNNSVNLDMTQTQTARKSRDNLLSNIKSFSGDDDFFSINGSQCLNFGSFARRTKLRPLDDIDMMICIAASDDRKYSYVGDGIYSMGANQTDKNNGLNTNETNDLNSTKVINRFISKLSDLNDYRKAEMHKNHEAATLKLKSYDWNFDIVPCFYCKGDFYLIPDGKGNWKKTDPRIDNQRITAINQEHNGNLLALIRLVKYWNNRRITHTIGSYMLECMILERYENMITPEKWWIDLQFRDTLNHLSSAIYYSVNDPKGIQGDMNTFSYSEKVKISEALKNAYDKASEATTLETSNKDQKSAIKKWGEVLGDYFPKYTGV

SEQ ID NO: 4907 - protein, 330 aa, Anaerostipes hadrus
MATTVNNAFAEFMKEKVNLDQEKNKIARSSRDNLIDNIKGFSGDSDFFVVYTDKILRFGSFERRTKIRPIDDIDLMLCLSGEGTRTYIQSGEVFYINGSDADSKNGLMTDNTNYLNSTKVINRFISKLSDLQDYSKAEMHKNHEAATLQLKSYTWNFDIVPCFYTDTGFYLIPDGSGNWKKTDPRIDNERITDINQKHNGRLLELIRLAKYWNNRKVTIRIGSYLLECMILQKYENKEASENWWIDLEFRDLLNYLSSAILSDVDDPKGIQGNLNSFCWDDRCKISDALTNAYNKAVEASNMELNDKNQKGAITKWGEVLGSDFPEYTGE

SEQ ID NO: 4908 - protein, 330 aa, Anaerostipes hadrus
MATTVNNAFAEFMKEKVNLDQEKNKIARSSRDNLIDNIKGFSGDSDFFVVYTDKILRFGSFERRTKIRPIDDIDLMLCLSGEGTRTYIQSGEVFYINGSDADSKNGLMTDNTNYLNSTKVINRFISKLSDLQDYSKAEMHKNHEAATLQLKSYTWNFDIVPCFYTDTGFYLIPDGSGNWKKTDPRIDNERITDINQKHNGKLLELIRLAKYWNNRKVTIRIGSYLLECMILQKYENKEASENWWIDLEFRDLLNYLSSAILSDVDDPKGIQGNLNSFCWDDRCKISDALTNAYNKAVEASNMELNDKNQKGAITKWGEVLGSDFPEYTGE

SEQ ID NO: 4909 - protein, 330 aa, Anaerostipes hadrus
MATTVNNAFAEFMKEKVNLDQEKNKIARSSRDNLIDNIKGFSGDSDFFVVYTDKILRFGSFERRTKIRPIDDIDLMLCLSGEGTRTYIQSGEVFYINGSDADSKNGLMTDNTNYLNSTKVINRFISKLSDLQDYSKAEMHKNHEAATLQLKSYTWNFDIVPCFYTDTGFYLIPDGSGNWKKTDPRIDNERITDINQKHNGKLLELIRLAKYWNNRKVTIRIGSYLLECMILQKYENKEASENWWIDLEFKDLLNYLSSAILSDVDDPKGIQGNLNSFCWDDRCKISDALTNAYNKAVEASNMELNDKNQKGAITKWGEVLGSDFPEYTGE

SEQ ID NO: 4910 - protein, 330 aa, Blautia obeum
MATTVNNAFAEFMKEKVNLDQEKTKIARSSRDNLIDNIKGFSGDSDFFVVYTDKILRFGSFERGTKIRPIDDIDLMLCLSGEGTRTYIQSGEVFYINGSDADSKNGLMTDNTNYLNSTKVINRFISKLSDLQDYSKAEMHKNHEAATLQLKSYTWNFDIVPCFYTDTGFYLIPDGSGNWKKTDPRIDNERITDINQKHNGKLLELIRLAKYWNNRKVTIRIGSYLLECMILQKYENKEASENWWIDLEFRDLLNYLSSAILSDVDDPKGIQGNLNSFCWDDRCKISDALTNAYNKAVEASNMELNDKNQKGAITKWGEVLGSDFPEYTGE

SEQ ID NO: 4911 - protein, 329 aa, Fusobacterium varium
MATTVNNAFTEFLKDKVNLEQDKTTIARTSRDNLIYNIKGFNEDSHFFKIYDEKILQFGSFGRRTKIRPIDDIDLMLCISGEGKRTYIKLNETFYINGSDSDSSNDLLTEGTNYLNSTKVINLFISKLSNLKDYSKAEMHKNYEAATLQLKSYTWNFDIVPCFYTDDNYYLIPDGMGNWKQTDPRIDNERTKNINQKHSAKLLDLIRLIKYWNNRKVTIKIGSYLLECIILNRYENLSINTWWIDIEFKETLKYLSSAILYKVDDPKGIQGDLNTFTWEEKKKISNALLIEYEKAVEAINKELNNKDQKGAITKWREILGSEFPEYTDK

SEQ ID NO: 4912 - protein, 170 aa, Enterococcus faecium
MAKSVTSAFSEFLRDSVNLDPSDTQKARNSRDNLIGNLNSFSGHDGFFVIYDSKNLKFGSFARRTKIRPIDDIDIILCFSAEETRKYVETSSGIDIIASENDKQNGLLIDGINYLNSTKVINRCIKKLSELRDYSKAELHKKQEAAILKLKSYTWYFDIVPCFTQIQICN

SEQ ID NO: 4913 - protein, 334 aa, Desulfotomaculum intricatum
MATTVNNAFEEFMRDKVNLDQEKTKTARKSRDNLIDNIHSLNSNEDFFNLYNDIDISFGSFGRRTKIRPLDDIDIMIGISGDGSTYYDSGNDVKIYVQNDDSAQKGCCNENTNVLNSTKVINKFISELKEFKDYKKAETHKNGAAATLQLKSYEWNFDIVPCFLTSEESNGRNYYLIPDGKGNWQKTDPRKDRDRVSTLNQKHNGLMLESIRLVKYWNKRPTMPLMSSYVLECLLLQYFDSVDSVSDYIDLRFRDILLYIKDNIWDSINDPKEIQGDLNTLTYDDKLKISNKANSDYDKAKEAISAEIEDKDQEKAIKKWGEIFGSEFPEYGED

SEQ ID NO: 4914 - protein, 161 aa, Leptotrichia goodfellowii
MEKTVKQAFQEFLENSVNLNRKATEDARKSRDNLKKNISEFGSDEDFFTLYEDFNIDFGSFARKTKCRELDDIDMMIGISANYATYNSEDSWDNTRIYANKSDVIQNECMNDDGTLNSKMVVNKFKEKLKKVNEYSKAEIKRNYEAVVLNLKSKTWNFDIV

SEQ ID NO: 4915 - protein, 329 aa, Selenomonas ruminantium
MDTANKLLTQLMVNKVNLDKDIVSQARKSRDNLLENIKSFSSEEDFFELCDDFNIQFGSFARKTKCQPLDDIDLMIGLSARGATYSGNSWDEIKISIRNPDFGQKMCMNDDGTLNSRKVLNQFKRKLQHVREYARSELNKRQEAVVLNLISKDWSYDLVPCFHTTKEYDGREYFLIPNGNGNWKKTAPDRDRAYVTRVNQEKDGMLLELVRLCKYWKSRKLKNILPSYLLETILVVHSKEVQYLKGNLLERFADALCAITDKICYSVPDMKNIQDDINDLDVSDRHAIYNKACDDYNKVLDVINYERIGSYTRAINILTDVLGDELLDE

SEQ ID NO: 4916 - protein, 342 aa, Oscillibacter sp.
MNLEAKEVEELATTVNNAFAEFMRDIVNLDPDVVSEARTSRDNLLDNIAEFDDKDGFFDLCDSFNVHFGSFARKTKCRDLDDVDLMIGIAANGATYYSDDPWDEVRITASTTNAAQKDCTREDGTLNSTQVSNKFKKKLESVREYSRSEIRRNGEAIILNLKSKEWSFDIVPCFHTVEESDGRSYYLIPNGNGNWKKTAPDKDKGHVTSTNQSKDGRVLELIRLCKKWNKVKNAKTLPSYMLETMIINFADSQAVLNEYIDLRFRDALSYIAGHILNPVYDMKGIQGDINNLGIDDKLRLQQKAWTDYNKACEAWQQEQAGNHKEAIKKWGEIFGSDFPTYG

SEQ ID NO: 4917 - protein, 332 aa, Oscillibacter sp.
MATTVNNAFAEFMRDIVNLDPDVVSEARTSRDNLLDNIAEFDDKDGFFDLCDSFNVHFGSFARKTKCRDLDDVDLMIGIAANGATYYSDDPWDEVRITASTTNAAQKDCTREDGTLNSTQVSNKFKKKLESVREYSRSEIRRNGEAIILNLKSKEWSFDIVPCFHTVEESDGRSYYLIPNGNGNWKKTAPDKDKGHVTSTNQSKDGRVLELIRLCKKWNKVKNAKTLPSYMLETMIINFADSQAVLNEYIDLRFRDALSYIAGHILNPVYDMKGIQGDINNLGIDDKLRLQQKAWTDYNKACEAWQQEQAGNHKEAIKKWGEIFGSDFPTYG

SEQ ID NO: 4918 - protein, 332 aa, Lachnoclostridium sp.
MATTVNNAFVEFMKDIVNLDPDVVCKARTSRDNLLDNIAEFDNRDGFFDLCDSFNVHFGSFARRTKCRELDDVDLMIGIAANGAKYYSDDPWDEVRITASTTNEAQKDCTREDGTLNSTQVSNKFKKKLESVREYSRSEIRRNGEAIILNLKSKEWSFDIVPCFHTVEESDGRSYYLIPNGNGNWKKTAPDKDKEHVTSTNQSKDGRVLELIRLCKKWNKVKNAKTLPSYMLETMIINFADSQTELSEYIDFRFRDALNYIASHILSPVYDMKEIQGDINNLSVDDKLCLQQKAQTDYKKACEAWEQEKASNHKEAIKKWGEIFGSDFPTYG

SEQ ID NO: 4919 - protein, 332 aa, Fibrobacter sp.
MAKKVDDAFAEFMKDDVDLDPTKVDAAKSSKSNLLDNIKDFDDGKFFRLYSDINIEFGSFARKTKIRPLDDIDIMIGIAADGATYNQNDAWNNVKVTASTTNAIQKSCANFDGTLNSTAVLNRFLSKLKQLPDYKKSEIHKNGEAVTLNLTSREWAFDIVPCFQTVVEEDNRNYYLIPNGRGGWQKTDPRVDRDYVKSVNSMKNGRVLSLVRLCKKWFEVKRFETPASYLLETLIVRYCDRVDDLNQFIDCRFSHCLKSIVDDIQKPIYDMKGIQGDINNISVLNRIKIASKANSDYQKSREAIITETKLYDQESAINIWHEIFGEDFPTYG

SEQ ID NO: 4920 - protein, 326 aa, Fibrobacter sp.
MAKMVNDAFDEFMRDSVNLDPQDVSDAKDSKNHLVDIISSYDSDDFFHLCKDFNEEFGSFARKTKMGILDDIDMMFGISADGATYNSNDNWQNVRVYGNYRVKQHRECMDEKTGLLNSRLVLNKFKDRLGQTYSTSDHPVRNGEAIKLKLTYNWSFDVVPCFYTVEDFFLIPNGYGGWKKTDPTKDRDFVKKVNKKHNGKVLPLVRLCKKWFEVKNVRTPASYMFETMVVNYCNDRLMLSEYIDLEFRDLLNYLRYAVYYQAVDMKGIQDDVNELSDEEKEIISFKAYKDYKKACLAIKAELDEKDWKKSINLWGEIFGEDFPTYG

SEQ ID NO: 4921 - protein, 328 aa, Pseudomonas kuykendallii
MTTNINTAFTTFLSDTVNLDPNDSAKAKQDRVNLETRINQIETNSSSFPKLLSEHNIHFGSFSRRTKKRPLDDVDMMFCLNAQGATYNEFAGNEGIDIYVNDTNSNLYRFTNDDNKTLNSIKVLNNFKIELGNIYEYRSSEINTRQEAVRLQLTTRDWSFDIVPCFYTDVDNYLIPDGQGKWKKTDPRIDKDRTTTINQANSGNVLNVIRIIKFWNSRPTMPTIPSYLLEVMILNYYQWRTSASSYVDLEIPGLLAHIRDKIYSVVTDPKGFQGNLNNLTLDQKSKIYSRAHEDYNKSIEARVAENTDIEECFRKWRQVFGTTFPAYS

SEQ ID NO: 4922 - protein, 332 aa, Pseudomonas amygdali
MATTVITAFNEFLQNSVNLDPEDTKAARLDRDNLRTRIQALETTVDYFPYLYTDADINYGSFSRRTKKRPLDDVDMFFCLMAQGATYNDYDPNNITLTLTDTSSRLYQYTKDDNRTISSIKILNKFKSSLANIYHYRSAEINRRQEVVLLNLVNKDWSFDIVPCFLTVEQFGKSFYIIPNGSGDWKKADPRIDKTRTASINQQNKGNLLNVIRTVKYWNSRATMHTMGSYLLENIILNFYQYRTDCTEFVDISLPAIFNHISTAVYQTVADPKGFQGDLNTLSFEQKVSISARATLDYQRATEARRLETEKDLKGSINKWREIFGNEFPTYG

SEQ ID NO: 4923 - protein, 332 aa, Unknown
  Description of Unknown: Pseudomonas sequence
MATTVISAFNEFLKEKVNLDPEDTKAARLDRDNLRTRIQGLQNSVDYFPTLYTEADINYGSFSRRTKKRPLDDVDMFFCLMAQGAVYNDYDQNNITVTIENTASNLYQYTKDDNKTISSIKILNKFKRSLENIYQYRNAEVNRRQEVVLLDLTNKDWSFDIAPCFRTVEQYGKSFYLIPNGTGDWKKADPRIDKNRTITINQQNNGNILNLIRIIKYWNNRATMHTMSSYLLENIILNYYQYRTDCSSFVDLSLADIFHHISLAVYQVVPDPKGFQGDLNNLTYEQRVSISTRAHQDYLKALEARRLEQNKDEQSSINKWREIFGLEFPAYG

SEQ ID NO: 4924 - protein, 332 aa, Unknown
  Description of Unknown: Pseudomonas sequence
MATTVISAFDEFLKETVNLDPEDTKAARQDRDNLRTRIQGLQTSVDYFPALYTEADINYGSFSRRTKKRPLDDVDMFFCLMAQGATYNDYDPNNITLTLENTDSNLYHYTKDDNETISSIKILNKFKKSLENIYQYRNAEVNRRQEVILLNLINKDWSFDIAPCFRTVEYFGKSFYLIPNGTGDWKKADPRIDKDRTAAINQQNSGNVLNIIRIIKYWNNRATMHTMGSYLLENIILNYYKYRTDCSRFVDLSLPNLFSHISSAVYQVVPDPKGLQGDLNTLTFEQKTSISARANQDYLKSLEARQFETNKDCKSSINNWREIFGLEFPAYG

SEQ ID NO: 4925 - protein, 333 aa, Pseudomonas sp.
MPTNVNTAFNKFFDEIVNLATEDSRSARTDRDNLRSRIQGLQSQVAYFPALYTEADINFGSFARKTKKRPLDDVDMFFCIKGNGAHYNEGLDGVIKIHVTDSSTNLYQFTNSDNETLNSIKVLNKFKSSVESVYAYRSSEVNRRQEVVVLKLNNKDWSFDIAPCFLTASVNDKNFYLIPDGAGNWKKADPRVDQERTTRVNQKHDGKILNIIRVMKYWNARATMPTMSSYLLENIIVNYYEAAYSCSGYIDLELPNVFQAVRDAVFSTVPDPKGFQSDLNDLSFDDKLKIYTRAGLDKDKAVEARRLETVCSTHKECINKWREIFGSEFPEYG

SEQ ID NO: 4926 - protein, 333 aa, Pseudomonas sp.
MPTNVNVAFSKFLSETVNLYSEDSKTARTDRDNLRKRIQRFQSEVVNFPTLHTDADINFGSFARKTKKRPLDDVDMFFCMNGSGAHYNEVSDGVIKIHVTNTNTNLYQFTNNDNETLNSIKILNKFKISVESVYAYRSSEVNRRQETVVLTLNNKDWSFDIVPCFITSTVNNKDFYLIPDGAGNWKKADPRIDQSRTTRINQKHNGKILNVIRVMKYWNARATMPTMSSYLLENIILNHYDVASSCSDYIDVELPYAFQAVRNAIFSTVPDPKGFQSDLNDLSFDDKLKIYTRAGTDKDKALDARRLERECQTHKESINKWREIFGSDFPEYG

SEQ ID NO: 4927 - protein, 334 aa, Algoriphagus vanfongensis
MASTVNNAFNTFMKDNVRLDSGRNSLAKSSKNNLIIEIGKFPDDGKFLDYYPEYTNIDYGSFSRKTKIRPLDDIDLMIVLHAQGNWREPIDGGFRIRVRPEASKQMALCNTGTDVLNSIKVINKFKEYLAKVPSYKKADIKRNQEAATLELNSYEWVYDIVPCFETAPDNFGKTFFLIPDGSGNWKPTDPRIDKNRTTTINGKQQISVLDMIRIMKYWTKRRTAATMGSYFLECLILQYYDSTTVNSSTYIDLELPNLFAYVYHQIHQSLNDPKGFQGDLNKLTWDERNSIQERAKLDYHRSVAAREFETNGKQKESIEKWGEIFGPEFPNFSA

SEQ ID NO: 4928 - protein, 322 aa, Algoriphagus vanfongensis
MKDNVRLDSGRNSLAKSSKNNLIIEIGKFPDDGKFLDYYPEYTNIDYGSFSRKTKIRPLDDIDLMIVLHAQGNWREPIDGGFRIRVRPEASKQMALCNTGTDVLNSIKVINKFKEYLAKVPSYKKADIKRNQEAATLELNSYEWVYDIVPCFETAPDNFGKTFFLIPDGSGNWKPTDPRIDKNRTTTINGKQQISVLDMIRIMKYWTKRRTAATMGSYFLECLILQYYDSTTVNSSTYIDLELPNLFAYVYHQIHQSLNDPKGFQGDLNKLTWDERNSIQERAKLDYHRSVAAREFETNGKQKESIEKWGEIFGPEFPNFSA

SEQ ID NO: 4929 - protein, 331 aa, Chryseobacterium limigenitum
MAKTVNAAFDYFLREKVRIDKDRSDVAKSSKSNLIEEIKKFPNDGKFPQLHPDISIDYGSFSRKTKIRPLDDIDLMIILDGQGSTWDEVGDHLVIRVNNSASKLLDLCHDFSNELNSIKVVNKFVEYLSGVTNYKKADVKRNMEAATLNLISYEWIYDIVPCFITKEDGLGKQFYVIPDGKGNWKATDPRIDKVRTQQVNNAQKVSVLDMIRLMKYWTKRPTMPTMKSYFLENLILDYYGAHNDSVQWVDRELPSLFQYIYHNVMKVLNDPKGYQGDINHLSYEERQKIKDRASTDYDKALEAIQFEIDNDMSRAIGKWREIFGDEFPMYY

SEQ ID NO: 4930 - protein, 330 aa, Chitinophaga filiformis
MAKTVGTAFSLFLTNFVRIDKDRNDVAKASKGNLLAEIERFPDDGRFFKLYPGMSFIDYGSYSRKTKIRELDDIDLMIVMNAEGNYRQELWGGGYQVRLRNWGTRQDGMVNPGTDIVNSIKVVNRFKDYLKGVSSYEKADIKRNQEAATLKLKSYEWVYDIVPCFQTVPINGDTFFLIPDGKGNWKPTDPRIDKERTARIHSQQAISVLDMIRLMKYWTKRRTAATMGSYFLECLILDYYERNTSGTDIAVELRNLFAFIFQRVHQALLDPKGYQGDLNTLNLDERNSIQSRASLDYNRANDAINLKSQGRDDLAIAKWIEVFGPDFPTY

SEQ ID NO: 4931 - protein, 333 aa, Flavobacterium sp.
MATTVNQAFEQFLHYYVRIDTARSDTAKSSKNNLVSEIKKFPDDNKFPLLHPDVSIDYGSFSRKTKIRPLDDIDLMIVLHAESNSRTQYSDRFEISVPPAATRQIALCNAGTNILNSIKVINKFISSLSSVSYYDKAEIKRNQEAVTLSLKSYEWVYDIVPCFITAPLADGSTFYLIPDGKGNWKATDPRIDKKRMDYINSIQEVSVIEVIRILKYWTKRPTMPTMKSYFLENLILNYYNSGVESSKYIDIEIPKVLAYIHNNIHKPLNDPKGFQGDINHLTYEERNSIQSKAAVDFKTANEARQLEIGKKIKESIIKWGSIFGSEFPKYTGS

SEQ ID NO: 4932 - protein, 331 aa, Unknown
  Description of Unknown: Bacillus sequence
MVKTANSAYDNFIKNSVDLDSEQTGIARNSRDWLYGNLKNFPKVVENFPKLYAGKEIIGFGSFRRRTKIRPLDDIDLMLVFTGEGTTYTEYADKIVLNVPEDADKLRKLVNDDGTLNSIRVIEKIKSSLSIIPQYKKAEIHRRQEATTLELSTYDWVFDIVPAFITSENAYGKSYYIIPDGSGNWKKTDPRIDNERATETNQKFDGNVLGLIRVIKYWNTNCSKKISSYLMENIVLDYFQNKFYWNGMKQELRGFFEYLKTSIYNSHYDPKGIQGDLNTLDYNTKFSISNQSSGCFENIDLAIRYENLGQHKEAIECWKKVFGDEFPSHED

SEQ ID NO: 4933 - protein, 331 aa, Unknown
  Description of Unknown: Bacillus sequence
MVKTANSAYDNFIKNSVDLDSEQTGIARNSRDWLYGNLKNFPKVVENFPKLYAGKEIIGFGSFRRRTKIRPLDDIDLMLVFTGEGTTYTEYADKIVLNVPEDADKLRKLVNDDGTLNSIRVIEKIKSSLSIIPQYKKAEIHRRQEATTLELSTYDWVFDIVPAFITSENAYGKSYYIIPDGSGNWKKTDPRIDNERATETNQKFDGNVLGLIRVIKYWNTNCSKKISSYLMENIVLDYFQNKFYWNGMKQELRGFFEYLKTSIYNSHYDPKGIQGDLNTLDYNIKFSISNQASGCFENIDLAIRYENLGQHKEAIECWKKVFGDEFPSHED

SEQ ID NO: 4934 - protein, 331 aa, Bacillus cereus
MVKTANSAYDNFIKNSVDLDSEQTGIARNSRDWLYGNLKNFPKVVENFPKLYAGKEIIGFGSFRRRTKIRPLDDIDLMLVFTGEGTTYTEYADKIVLNVPGDADKLRKLVNDDGTLNSIRVIEKIKSSLSIIPQYKKAEIHRRQEATTLELSTYDWVFDIVPAFITSENAYGKSYYIIPDGSGNWKKTDPRIDNERATETNQKFDGNVLGLIRVIKYWNTNRSKKISSYLMENIVLDYFQNKFYWNGMKQELRGFFEYLKTSIYNSHYDPKGIQGDLNTLDYNTKLSISNQASGCFENIDLAIRYESLGQHKEAIECWKKVFGDEFPSHED

SEQ ID NO: 4935 - protein, 331 aa, Unknown
  Description of Unknown: Bacillus sequence
MVKTANSAYDNFIKNSVDLDSEQTGIARNSRDWLYGNLKNFPKVIENFPKLYAGKEIIGFGSFRRRTKIRPLDDIDLMLVFTGEGTTYTEYADKIVLNVPGDADKLRKLVNDDGTLNSIRVIEKIKSSLSIIPQYKKAEIHRRQEATTLELSTYDWVFDIVPAFITSENAYGKSYYIIPDGSGNWKKTDPRIDNERATETNQKYDGNVLGLIRVIKYWNTNCSKKISSYLMENIVLDYFQNKFYWNGMKQELRGFFEYLKTSIYNSHYDPKGIQGDLNTLDYTTKLSISNQASGCFENIDLAIRHESLGQHKEAIECWKKVFGDEFPSHED

SEQ ID NO: 4936 - protein, 326 aa, Sporolactobacillus pectinivorans
MLVTVNSAFNDFIRDYVDLDGKITTSGRNSRDWLYDQLKTFPDKVENFPILYKDKEVMSFGSFRRRTKIRPLDDIDLMLVFSGDGTTYFENNGTITLNVPDSAELLKKLTNDDGVLNSIRVIEKIKSSLSIIPQYQKAEIHRRQEAATLDLSSYDWVFDIVPAFITTRDGNNKDYYIIPDGAGNWKKTDPRLDNDRATNINQRFNGNILGFIRLIKYWNTNCSIKISSYLIENIVIDYFENRFWWNGRTQELRDFFNDLSTSIFNSHLDPKGIQGDLNTLDWDSRQKVSSQANECVQNINNAIYYENQGYSNEALECWRNVFGSNF

SEQ ID NO: 4937 - protein, 334 aa, Bacillus cereus
MAVKTVNIGFDTFIKDFVDLDKDNTEKARSSRAWLYEQLKGFPASVDNFPNLYNGKETKGFGSFRRRTKIRPLDDIDFLLVFSGEGTTYTEYSVDEIELTVPESAEKLRQLCNDDNKLNSIKVVEKIKKSLSNIPQYQKAEIHRRQEAATLKMTSYDWNFDIVPAFITSEDNQGKTYYIIPNGSGKWKKTDPRIDNERTKNANQSFGGNVLGFVRLIKYWNCNSTAPKISSYLMENIILDYFDSKYSWTGRKEEIRDFFWDLKTSIYCAHYDPKGIQGDLNNLDFDTKSKISNQAGNCYDYVCEAIELENKGNHKEAVDKWRKVFGDEFPGYED

SEQ ID NO: 4938 - protein, 334 aa, Bacillus timonensis
MAVKTVNVGFDTFVREFVDLDKDETTKARSSREWLYDQLKGFPVNVEDFPKLYSGNEIKGFGSFRRRTKIRPLDDIDFLLVFSGDGTTYTEYSVDEVVLNVPESTEKLRSLCNDEGKLNSIKVIEKIKKSLSNIPQYQKAEIHRRQEAVTLKMTSYDWNFDIVPAFITAEDNQGRSYYIIPNGNGKWKKTDPRVDNERVKNTNQRFDSNVLGFIRLIKYWNCNSSVPKISSYLMENIVLDYFDSKYTWLGRKEEIRDFFWDLKSSIYNSHYDPKGIQGDLNNLDFDTKWKISNLAGNCYDYASEAIEFESQGMHKEAVEEWRKIFGDDFPEYED

SEQ ID NO: 4939 - protein, 332 aa, Bacillus firmus
MVKNVDSAFNKFIRDVVDLESEVSKNARRSRDWLYDQLKCLPDKSDEFPHLFSGKEVKGFGSFRRRTKIRPLDDIDLLLVITGEGTTYTELADKITLQVPEKAERLKRLTNDDGTLNSKRLIEKVKKALSGIHQYENAEIHRREEAATLKLKSYDWVFDIVPAFITAENSAGKTYYIIPDGSGNWKKTDPRIDNERTTEINKNFEGKVLSFIRLVKYWNTNVSTCTISSYLIENLVLNFFSGKHDWQGKKEELKNFFSYLKGEIYNSVLDPKQIQGDLNHLNIFEKMEVSDLASKAFISIDNAIQKENEGEQEQAIGHWKEVFGKEFPTYEG

SEQ ID NO: 4940 - protein, 329 aa, Amphibacillus xylanus
MPLSTYTKVNMNTFIKDYINLDSEVTKKARASRDFLHDQLISLPEKAENFPSLYKDKETYNFGSFSRRTKIRPLDDIDFLLVFTGSGSTYIESGDILKITPPESATDLYKLRDDYGYLNSRKLLNKIKNNISKVSQYQKAELHSHKEAVTLNLTSYDWTFDIVPAFITAEDAYGKSYYVIPDGNGHWKKTDPRIDQKRVTSVNTSTDYDVLEFVRIIKYWNEVQSIKISSYLVENIVLDYFENEYIWPTRRTQLKAFFKYLKTAIWNSVMDPKGLQGDLNDLDFSKKLSIETKANECMNAVEDAIEYEDAGEYENADKKWRVVFGDEYD

SEQ ID NO: 4941 - protein, 327 aa, Bacillus mycoides
MTTYTKVDMDNFIKEKINLDAEITKIARNSRDFLYEQLKSLPGKADNFPRLYPNKEIYNYGSFSRKTKIRPLDDIDFMLVFSADGSTYGDMDGTIKMSVPESATNLHKLRDDYGYLSSRKVANKIKNNISKVSQYQKAEIRSSQEAVILNLISYDWTFDIIPAFVTVEEFDGRSYYLIPDGNGHWKKTDPRIDQTRVTEVNKKTDFNVLEFIRIIKFWNKVQNLKVSSYLIENMVLNYFENEFIWSTKRYQLMYFFEYLKGSIYMPVNDPKGLQGDLNDLESSKKQAIDNKASACEEAARKAIEYENEKDYENADKQWRVIFGDEYV

SEQ ID NO: 4942 - protein, 327 aa, Bacillus cereus
MTTYTKVDMDNFIKEKINLDAEITKIARNSRDFLYEQLKSLPGKADYFPRLYPNKEIYNYGSFSRKTKIRPLDDIDFMLVFSADGSTYGDMDGTIKMSVPESATNLHKLRDDYGYLSSRKVANKIKNNISKVSQYQKAEIRSSQEAVILNLISYDWTFDIIPAFVTAEEFDGRSYYLIPDGNGHWKKTDPRIDQTRVTEVNKKTDFNVLEFIRIIKFWNKVQNLKVSSYLIENMVLNYFENEFIWSTKRYQLMYFFEYLKGSIYMPVNDPKGLQGDLNDLESSKKQAIDNKASACEEAARKAIEYESEKDYENADKQWRVIFGDEYV

SEQ ID NO: 4943 - protein, 327 aa, Bacillus sp.
MTTYTKVDMDNFIKEKINLDAEVTKIARNSRDFLYEQLKSLPGKADNFPRLYPNKEIYNYGSFSRKTKIRPLDDIDFMLVFSADGSTYGNMDGTIKMSVPESATNLHKLRDDYGYLSSRKVANKIKNNISKVSQYQKAEIRSSQEAVILNLISYDWTFDIIPAFVTAEEFDGRSYYLIPDGNGHWKKTDPRIDQTRVTEVNKKTDFNVLEFIRIIKFWNKVQNLKVSSYLIENMVLNYFENEFIWSTKRYQLMNFFGYLKGSIYMPVNDPKGLQGDLNDLESSKKQTIANKASACEEAARKAIEYESEKDYENADKQWRVIFGDEYV

SEQ ID NO: 4944 - protein, 332 aa, Unknown
  Description of Unknown: Lysinibacillus sequence
MAKSIHASINEFSKNCVDLDPTKLGTARSSRNWLVDKIENFEKTDNEFPEIYKKENNVQMGSFARRTKIRPLDDIDFIVVFDGKGSKYVTNSYGEITINVPETATNLSRLTNDENSLNSIKLLNKLKSSLQNVPQYSAADIKRNFEAITLKLTSYDWNFDIVPAFITAPDSSQRTYYLIPDGQGKWKKTDPRIDARRATEINQKRDGKVLRIIRLIKYWQKRHSVPNIGSYLLENLLLNYFNNNEVSASDQVTLRDVFSYLRNSIYHSCNDPKEIQGNLNLLNLDVKDRFSEAAANASICAQNAINFMAKDDHKAAHAEWKKVFGSEFPDYE

SEQ ID NO: 4945 - protein, 332 aa, Lysinibacillus sphaericus
MAKSIFTSINDFSKNCVDLDPTKLGTARNSRNWLVEKIESFEKTDEYFPEIYTKENNVQMGSFARRTKIRPLDDIDFIVVFDGKGSNYGTNSNGEIIINVPETATKLRRLTNEDYTLNSIKLLNKLKISLQNVPQYSAADIKRNYEAITLKLTSYDWNFDIVPAFITVPDSSQRSYYLIPDGNGKWKKTDPRVDAKRATEINQKRDGKVLRIVRLIKYWQKRHGVPNIGSYLLENLVLNYFDTNEVSATDQLTLRDVFTNLSNSIYHNCYDPKGIQGDLNTLTLDVKDKFSEAAAKASTCAQNAINFVAKDDHKAAHAEWKKVFGSEFPEYG

SEQ ID NO: 4946 - protein, 332 aa, Bacillus megaterium
MSKNTFTSISDFSKNCVDLDSTKLGTARSSRNWLVGQIENFENSDEYFPGIYTKENNVQMGSFARRTKIRPLDDIDFIIVFTGNGSTYATNFNDEITISVPETATKLRRLTNDDYTLNSIRLLNKLKSSLQNVPQYSEADIKRNQEATTLKLTSYDWNFDIVPAFITAPDSSQRTYYLIPDGNGKWKKTDPRIDAKRATEINQKRGGKVLRIIRLIKYWQKRPVVPNISSYLLENLVLNYFDTHEVGVTDQWALKDVFYNLSNSIYSSCYDPKEIQGDLNTLPFETKQKFSEAATKAYLCAKNAIDFVAEDDHKAAHDEWKKVFGSEFPDYE

SEQ ID NO: 4947 - protein, 332 aa, Virgibacillus dakarensis
MASIYSSINTFAKNIVDLDPENLAKARSSRKWLVGKIEDFPTTDESFPKIYTAENDVQMGSFSRRTKIRPIDDIDFIVVFNAEGTTYSTSIFDGKISMNVPETATRLKALTNDDNTLNSIKLLNKLKSSLKDVPQYDQADIKRNKEAVTLKLKSYTWNFDIVPAFLTKPESDGRSYYLIPDGYGNWKKTDPRVDAARATRINQKRDGKVLRYIRLIKYWHRRPIMSNIGSYLLENLVLNYFDNNDVSVTDQFTLRNIFFYLSTNIYYSCPDPKGIQGDLNTLDQDTKNKFSAAASLACTYADNAINYSINDNHKAAHDEWRKVFGGEFPEYE

SEQ ID NO: 4948 - protein, 332 aa, Exiguobacterium acetylicum
MPKVISTSLSQFSKDKVDLDASRLSIARTSTKALVDKIEKFEDSDDSFPAIYKDENYVRMGSFARRTKIRPLDDIDFLIVFQANSSTYLEKSNGVCEIKVPTTSISLYNLTNDDGTLNSIKLLNKLIKSLQSVPNHSLATIKRNQEAATFKFSSYEWNFDIVPAFITSKDIYGNSFYLIPDGNGKWKKTNPRIDSARATEINQKRDGKVLRIIRLIKKWHSQQHVPNVGSYLLENMILNHYEYNEVGSTDQIALRDLFNVLSSSIYSPCLDPKGIQGDLNHHSFETQKRFSAAAYKAYERSSLAIQYFLENKHKLSHQEWQKIFGSDFPDYE

SEQ ID NO: 4949 - protein, 343 aa, Paenibacillus borealis
MSVAEKETIKTVSKAFGHFSKTIVDLDPTVTSSARSSRSWLVGKLESFPGSVDGFPNIYEAENDVQMGSFSRRTKTRPLDDIDFLLVFSADGAWYTPTTSHTDIIITVPSTASNLYKLCDNGELNSRKFINKIVSALSNVPQYDQADIGRNQEVATLKLKSYSWNFDIAPAFITAPDAYGKTVYLIPDGNGKWKETDPRIDASRTTSINAKHNGKVLKLIRLIKYWNKNRSMPTISSYLLENLALNYFDSKYFLGATEESLKGFFADLQNSIYLDCQDPKGIQGNLNTLDFTTQMKISAAAKKAEEYAASAIQAAEDGDQEEALDHWIEVFGSEFPAYGQEVE

SEQ ID NO: 4950 - protein, 330 aa, Alicyclobacillus mali
MARTVASAFRQFARDYVDLNPEDVSGARRSRDWLVKIIESFPSKYKGFPIIYKEESPVLMGSFARSTKIRTLDDVDLIIVFSAQGSTYTESSDKIEVHVPESAPQLRRLCDDGVLNSRRVLNLLKAFLSEVPQYDNSEIHRSQEAVTLHLSSYDWNFDIVPAFITKPRVDGRTYYVIPDGRGAWKFTDPRIDAKRATDTNQRHDGRVLGLIRLLKYWNRRCAVPAISSYLLENMAISFFEKKRVIGSVGEALRDLFTFISTAVYSPCPDPKGIQGNLNNLDDDVRDKVHSAAASASKQATAALYAEAKGDHEIAIEAWKRIFGSEFPGYG

SEQ ID NO: 4951 - protein, 335 aa, Unknown
  Description of Unknown: Acinetobacter sequence
MARTINGALNELVQDKVNLLKSRTDAGRRSRDHLLAQIKLLNANSAEKLDFAETYNLPFGSFSRRTKVKPLDDIDQMIGLNGGKFVWNEASNYDEAIISISNPSDKGIWSQLLNDDDTLSPIKVLNRFKRMLSNMSGYQNPQLNRRQQAVTFQMTSNEWNFDLVPCFYTQSGVYLIPSGNGNYWMQTDPRKDQTLATEVNQKYNGQILEIIRLIKYWNKIDRKTSIPSSYLLEVMLLNFYKNRSNIWQPCGTLQVEVQQCLNYIKDNIYYDVTDPKGIEGNINRLDRDLQNKIYVRTSNDLENIQNGNYYEDIGEKEKAFEYWENVLGSFFPAYG

SEQ ID NO: 4952 - protein, 335 aa, Unknown
  Description of Unknown: Acinetobacter sequence
MASTINGALNELVQDKVNLLKSRTDAGRRSRDHLLAQIKLLNANSAEKLDFAETYNLPFGSFSRRTKVKPLDDIDQMIGLNGGKFVWNEASNYDEAIISISNPSDKGIWSQLLNDDDTLSPIKVLNRFKRMLSNMSGYQNPQLNRRQQAVTFQMTSNEWNFDLVPCFYTQSGVYLIPSGNGNYWMQTDPRKDQTLATEVNQKYNGQILEIIRLIKYWNKIDRKTSIPSSYLLEVMLLNFYKNRSNIWQPCGTLQVEVQQCLNYIKDNIYYDVTDPKGIEGNINRLDRDLQNKIYVRTSNDLENIQNGNYYEDIGEKEKAFEYWENVLGSFFPAYG

SEQ ID NO: 4953 - protein, 225 aa, Acinetobacter sp.
MASTINGALNELVQDKVNLLKSRTDAGRRSRDHLLAQIKLLNANSAEKLDFAETYNLPFGSFSRRTKVKPLDDIDQMIGLNGGKFVWNEASNYDEAIISISNPSDKGIWSQLLNDDDTLSPIKVLNRFKRMLSNMSGYQNPQLNRRQQAVTFQMTSNEWNFDLVPCFYTQSGVYLIPSGNGNYWMQTDPRKDQTLATEVNQKYNGQILEIIRLIKYWNKIDRKTS

SEQ ID NO: 4954 - protein, 335 aa, Acinetobacter sp.
MARTINGALNELVQDKVNLLKSRTDAGRRSRDHLLAQIKLLNANSAEKLDFAETYNLPFGSFSRRTKVKPLDDIDQMIGLNGGKFVWNEASNYDEAIISISNPSDKGIWSQLLNDDDTLSPIKVLNRFKRMLSNMSGYQNPQLNRRQQAVTFQMTSNEWNFDLVPCFYTQSGVYLIPSGNGNYWMQTDPRKDQTLATEVNQKYNWQILEIIRLIKYWNKIDRKTSIPSSYLLEVMLLNFYKNRSNIWQPCGTLQVEVQQCLNYIKDNIYYDVTDPKGIEGNINRLDRDLQNKIYVRTSNDLENIQNGNYYEDIGEKEKAFEYWENVLGSFFPAYG

SEQ ID NO: 4955 - protein, 335 aa, Acinetobacter sp.
MARTINGALNELVQDKVNLLKSRTDAGRRSRDHLLAQIKLLNANSAEKLDFAETYNLPFGSFSRRTKVKPLDDIDQMIGLNGGKFVWNEASNYDEAIISISNPSDKGIWSQLLNDDDTLSPIKVLNRFKRMLSNMSGYQNPQLNRRQQAVTFQMTSNEWNFDLVPCFYTQSGVYLIPSGNGNYWMQTDPRKDQTLATEVNQKYNGQILEIIRLIKYWNKIDRKTSIHSSYLLEVMLLNFYKNRSNIWQPCGTLQVEVQQCLNYIKDNIYYDVTDPKGIEGNINRLDRDLQNKIYVRTSNDLENIQNGNYYEDIGEKEKAFEYWENVLGSFFPAYG

SEQ ID NO: 4956 - protein, 333 aa, Acinetobacter indicus
MARTINGALNELVQDKVNLLKSRTDAGRRSRDHLLGQIKRLNDSSLEKLDFADTYNLPFGSFSRRTKVKPLDDIDQMIGLNGGKLVWNEATNYDEAIISILNPLDKGIWSQLLNDDDTLSPIKVLNRFKRMLSGMSGYQNPQLNRRQQAVTFQMTSNEWNFDLVPCFYTQSGVYLIPSGNGNYWMKTDPRKDQTLASEVNRQHNGKVLEIIRLMKYWNKQDRKPSIPSSYLLEVMLLYFYKSRWLTTAGTLQEEVEKSLIYIRDNIYSWIEDPKGIEGNINRLDHDVQNKIHARVTNDLENIKYGNYYESIGEKERAFEYWEKVLGSFFPAYG

SEQ ID NO: 4957 - protein, 331 aa, Prevotella intermedia
MPYSVNSCFDVFMRDFVNLNPERTTTARASRDWLVHKIEELSNSERIPPLYNGANHIFFGSFARNTKIRPLDDIDIMIMFDAQGCTTDDVAKKIRKTYPIYVNNPDAKLLSDYCDGNILNSRRMIEAIKKELGNIPRYSKAEIHRNQEAVTLQLSSYEWNFDIVPCFYTTTGFYVIPDGNGSWKGTDPRIDQNRVTQANQWVNGKLLPATRLMKYWKKEHWGNEVISYLFENFMIDWVNNLTIFPSTYPQLVKRALEVLSSKIMMDYNDPKGFQGNINNLDIHARSRLAIMASQDASEARAAIQYEQNYMTEAAINKWIKIFGNEFPRYGK

SEQ ID NO: 4958 - protein, 332 aa, Prevotella intermedia
MAYTVNSSFEDFMRDSVNLDPERTTKARTSRNWLIHQIEELANNGKIPPLYNGTNHIFFGSFARNTKIRPLDDIDIMIMFDAQGCTTDDVAKKIRKTYPIYVNNPDAKLLSDYCDGNILNSRRMIEAIKKELGNIPRYSKAEIHRNQEAVTLQLSSYEWNFDIVPCFYTTTGFYVIPDGKGNWKGTDPRIDQNRVTQANQQVNGALLPAIRLMKYWKKEHWGDEVSSYLFENLMIDWANSLYSFPMTYPQLVKSALDGLSSLIMRDCYDPKGFQGSINDLDLYDRRRLAIMASQDASEASTAIQYEQNYMTEAAINKWIKIFGNEFPKYGKK

SEQ ID NO: 4959 - protein, 332 aa, Cetobacterium ceti
MSIVTLKQAQNKFLKEIVDLEPGRVEKARKSRDFLKETIKNICEKDKEMFNLYPEYHIDFGSFARNTKIRPLDDIDMMFCFKGEGSVYDILGNESYKITVPTESKTLIKVCEENNQLNSRKVIEKIKAKLYNISNYNRADIKRNQEAITLKLNSYEWNFDIVPCFICNEGDEKAKFYLIPDGNGNWKKTDPRKDRERIKELNNINNGSVYQLVRLAKKWSKQKNFQSISSYLLENLVLEYVASTSISNNTYDEFESFLDYLKDKIYEKIKDPKGIQDDLNNLEFLHKYKISIAAQRDAEILRESNDIYLREETKINFYIKVFGNDFPKYGDN

SEQ ID NO: 4960 - protein, 347 aa, Clostridium sp.
MASNVNTAFSEFLNSIVNVKKEESDKAKKSRDFLLEQIQSVSANGVFLSLAPQYNSFFGSFARKTKIQPLDDIDIIIGLSGDFLQMEGYEWNNITLKVKNDCSDRRIIDSSDKFTQYWGLPIYQLNSNIVKNKLVSALKNIPQYEKSEIHARGEAVTLKLKSYSWNFDIVPAFYCSGNGVPYYLIPNGYGKWKKTNPKTEQDRLSKLNAKFNGIVLSTIRLVKYWNRRGQMPNITSYVLETMVLDYFTQTNNSVYSNGKCYDYPDMHFRDALLYIANNIMCSVQDSKGIQGNINTLTYEQRLKIKTRANNDYYKSCNAVNAEIHEKNNHKSIDIWRDIFGDDFPKYG

SEQ ID NO: 4961 - protein, 347 aa, Clostridium sp.; identical to SEQ ID NO: 4960

SEQ ID NO: 4962 - protein, 329 aa, Candidatus Cloacimonas sp.
MANNVNAAFTEFNRDFVNLDSEKTPVARKSRDWLIKQLENLPNKVNDFPKLYDGMHIKFGSFARNTKIRPLDDIDLILTFSAEYTTHTILNYGENYILNVPESATLLRKLCNNDNTLNSIKLVNKIVASLDEIEHYKSADKHRRQEAATLQLNSYDWNFDIVPAFYTKTGYYLIPDGSGGWKATDPRIDQNKTKEVNQKHNGKILQIIRTLKYWNRRAQMPTIPSYLFENLVLNFFDSETEISKWIDVNLLYFWNYLKNAIYNSVADPKGFQNDLNTLSYGDRIKISNKASDTYDKGYGAYKVETEEENQENAISKWRDIFGTDFPKYE

SEQ ID NO: 4963 - protein, 328 aa, Cellulophaga baltica
MAKTVNSAFATFNKDFVNLDSGKTNTARTSRDWLYGQLNNFPDNDESFPLKYEDRHHKFGSFARNTKIRELDDIDLIYCLHGNNAYYSKSIFGNKYYLHTENAGIRLKNLSDNNQLNSIKVVNKFVSSLSNISQYKSAAIHRRQEAATLNLTSYDWSFDIVPAFYTTSGFYLIPDGSGNWKATNPPLDQKYVTDLNNKHTHSVHQLIRTLKYWNRRAKMPTISSYLFENFVLNFCEYQDKLSDYIDVNVINFWYYLKSEVYNDVKDPKGIEANLNSLTYEEKQKISEKANEAYKIGYEANRLETKESDQESAINKWRQIFGNDFPEYN

SEQ ID NO: 4964 - protein, 329 aa, Flavobacterium sp.
MAKTVDSAFIEFNRDFVNLDSEKTKTARSSRDWLFTQLNNFPINDESFPLKYIERHIKYGSFSRNTKIRELDDIDVIYCLHADSAHYSESFLQPKTYYIHTENSGDRLKNLSDNNKLNSIKVVNKFVSSLSNISQYKSAKIHRRQEAATLNLTSYDWTFDIVPAFYTKNGFYLIPDGKGNWKATNPALDDEYITNLNKNYNYSIHQLVRTLKYWNRRAKMPTMSSFLFENFVLNFVESKSELSKHIDINLINFWSYLKTAVYNNVNDPKGIDSNINQLSFEDKNKIFERAKDSYEKGYEAYRLETEDKNQNSAINKWKEIFGNDFPPYN

SEQ ID NO: 4965 - protein, 357 aa, Pedobacter suwonensis
MILLKMCNYGLPYSYMLFLFHISKSNFQYFFMAQTVNTAFNEFNTNIVNLDPNRTDRANSSRDWLWEQLNKLDDKDDLDFPFKYKERHIKYGSFARKTKIRELDDVDVMFCLTANGATYLKQYENYIINTPNAGNRLRLLSDNDILNSTKVVNKLKLSLAKIEHYKSAKLHNRGEAATLDLNSYEWVFDIVPCFYTDTDLYLIPDGNGNWKSTDPRVDQKLVTEVNQKNQGRALQLIRTLKYWNRYNSTHTITSYLFEQIVINFITTSQLGQWLDFDIRDFFYYLSVHIYYAVNDPKGIQGDLNYLTYEQKKAILEKSSWAFDKAKEAVSAETQEKNQEKAINKWREIFGYNFPKYE

SEQ ID NO: 4966 - protein, 326 aa, Pedobacter suwonensis
MAQTVNTAFNEFNTNIVNLDPNRTDRANSSRDWLWEQLNKLDDKDDLDFPFKYKERHIKYGSFARKTKIRELDDVDVMFCLTANGATYLKQYENYIINTPNAGNRLRLLSDNDILNSTKVVNKLKLSLAKIEHYKSAKLHNRGEAATLDLNSYEWVFDIVPCFYTDTDLYLIPDGNGNWKSTDPRVDQKLVTEVNQKNQGRALQLIRTLKYWNRYNSTHTITSYLFEQIVINFITTSQLGQWLDFDIRDFFYYLSVHIYYAVNDPKGIQGDLNYLTYEQKKAILEKSSWAFDKAKEAVSAETQEKNQEKAINKWREIFGYNFPKYE

SEQ ID NO: 4967 - protein, 327 aa, Elizabethkingia miricola
MAKTVGTAFSEFNKETVNLNPDRTSKANSSRDWLWGQLNTLDSKDNLDFPFKYQDKHIKFGSFARKTKIRELDDIDIMFCFTANGATYLKSGSVYYIHTPNAGDRLKKLSDNDILNSRKVVNKVKNSLSEIEHYKSADIHSKGEAATLSLQSYEWVFDIVPCFYTDTNLYLIPDGNGNWKSTDPRIDQYLVTSTNQNYNGKLLQLIRTLKYWNRYNSSYTIGSYLFEQIVINFVKTRNELSNWIDYDIRDFFYYLKSHIYTDVNDPKGIQGNLNNLTSEQKSSIADKANWAYNKAIEAITAETTEEDQEKAINKWREIFGTKFPIYE

SEQ ID NO: 4968 - protein, 327 aa, Chryseobacterium balustinum
MAKTVDKAFSEFNTETVNLNPDRTSKAKSSRDWLWGQLNALDSKEGLEFPFKNHYKHIKFGSFARKTKIRELDDIDIMFCFTANDATYSQSGNTYYIQTINAGERLKKLSDNNILNSKKVVNKVKNSLSEIEHYKSAEIHSRGEAATLSLQSYEWVFDIVPCFYTDTNLYLIPDGNGNWKSTDPRIDQDLITSTNQNYDGKLLQLIRTLKYWNKHNSSYIIGSYLFEQFVINFAKTKAELSKWIDFDIRDFFYYLKNHIYNNVNDPKGIQGNLNNLTFEQKYSISNKANWAYDKAVEAINAETKDSHQEKAINKWREIFGTKFPIYE

SEQ ID NO: 4969 - protein, 327 aa, Chryseobacterium sp.
MAQTVDSAFSEFNRDSVNLNPDRTAKAISSRDWLWGQLNILDSKDNLDFPFKYQDRHIKYGSFSRKTKIRELDDIDIMFCFTADGATYLRSGTTYYIQTPNAGERLKKLSDNDILNSRKVVNKVKNSLSEIEHYKSGDLHSRGEAATLSLQSYEWVFDIVPCFYTDTNLYLIPDGTGNWKATDPRIDQELVTSTNQNYNGRLLQLIRILKYWNKHNSSYTIGSYLFEQFVINFVKTKIELSQWIDYDIKDFFNYLANNIFYNVNDPKGIQGNLNNLTFDQKNSISEKANWAYNKSLEAITAETSEKNQEKAINKWCEIFGSKFPIYG

SEQ ID NO: 4970 - protein, 327 aa, Parabacteroides sp.
MAATVNSAFEEFNKNVVNLDPDRTSKAISSRDWLWGQLNKLDSKENLNFPFKYEDKHIKFGSFARKTKIRELDDIDLMFCLTANGATYTLYGSTYYINTPNAGSRLKNLSDNDILNSRKVVNKLKSALSEVEHYKSAELHSRGEAATLNLLTYEWVYDIVPCFYTDTELYLIPDGNGNWKATDPRIDQNLVTETNQNYAGRLLQLIRILKFWNRHNSSFTLSSYLFEQIVINFTKSKTALSEWIDINIKDFFSYLSTYIYYAVNDPKGIQGDLNCLTYEQRKSISEKAKWAHDKAVEAIDAEIKEKDQEKAINKWREIFGNKYPKYE

SEQ ID NO: 4971 - protein, 327 aa, Capnocytophaga sputigena
MAKTVGSAFEEFNKEVVNLAPDRTKKARDSRDWLIKKLSNFDQKEGLYFPFEYAEKHIKFGSFARKTKIRELDDIDLMFCLSGNYATYSYNDGIYYIHTENAGDRLKKISDNNILNSTRVINKFLSALLNVEHYSSADIHKRGEAATLKLTSYEWNFDIVPCFYTDKNFYLIPDGKGNWKATNPNIDQELITNVNQEYNGLVLQLIRTLKYWNRHNSTNTIGSYLFEQIVINFVKQKTKLSQWINFDIRDFFSYLSNNIFSPVYDPKNIQGDINDLTIGEQILISIKVNWAFTKANEAIFAETNEKNQEKAINKWREIFGNKFPKYE

SEQ ID NO: 4972 - protein, 327 aa, Flavobacterium johnsoniae
MANTVTNAFYDFNKDSVNLDPSRTDKANSSRDWLFSQLNNLDEKESLNFPFGFEDQNIKYGSFARKTKIRELDDVDIMFCLTADGATYTKNFDVYTISTYNAGQRLLNLSDNNVLNSKKVVNKLKVSLSDIQYYKQAELHSKGEAVTLDLQSYEWVFDVVPCFYTDTELYLIPDGNGNWKATDPRIDQNLITTTNQNYEGRLLQLIRTLKYWNRHNSSHTLSSYLFEQIVINYVNSTAELSQWIDFNIRDFFNYLSIHVYNAVNDPKGIQGNLNKLSFTEKQAVSQKANWAYEKAKQAINYEIEEKNQEKAINKWREIFGTKFPKYE

SEQ ID NO: 4973 - protein, 327 aa, Chryseobacterium sp.
MANTVDNSFIEFNREIVNLNSNITETANNSRDWLVTQLSSLDMKDGLDFPYEYIGMHVKYGSFARKTKIRELDDIDLLFCLKADGAYYTKIGDTYVISSVNSGQRLQNLSDNGTLNSRKIVNKFVNSLYELRHYKSAEIHRKGEAATLKLDSYVWVYDIVPAFYTDTALYLIPDGNGNWKATDPRIDQKLLTETNQSYESKVLQLIRTLKYWNRHNSTYTLGSYLFEQIVINFVKSKYELSTYMDFNIRDFFNYLSINIYNSVYDPKGIQGDINNLILSEKDSVSLKADWAYNKAKDAVFAETNEKNQEKSINKWREIFGNNFPQYG

SEQ ID NO: 4974 - protein, 327 aa, Gelidibacter mesophilus
MATSVNSAFSTFNEDYVNLLKERTNIARASRNWLYGQLNGLEDKDDLNFPYKYDGCHINYGSFERRTKIRELDDVDLMFCLGGSGAYYSKFGNEYTIHTPNAGSRLKYLSDSDILNSRRVVNKFKSSLSTIGQYKSAEINSRGEAATLKLSSYEWVFDIVPCFKTDTDIYLIPDGNGNWKPTDPRIDQKRITTANQNNKTLVLQLVRTLKYWNRRNSTYTISSYLFENIIINFVNSKAELNNYNDINIRDFFYYLSSAILNSVYDPKGFQGDMNTFTYVERVAISRKADWAYEKANEAVNAELKDKDQKKSINLWGEIFGANFPSYG

SEQ ID NO: 4975 - protein, 328 aa, Polaribacter atrinae
MATSVNSAFNEFNNDIVNLLKDRTDKARTSRDWLFTQLNGLDSKEDLNFPLKNESKHVNFGSFQRKTKIRELDDVDLMFCFNGNGATYTKYNTNHYKINTPNTGQRLKNLSDSDILNSRRVVNKVKNSLSQIGQYKSAELHSRGEAATLSLNSYEWVFDIVPCFFTDIDLYLIPDGNGDWKPTDPRIDQKRVTDANQAKDGRTLQLIRILKYWNRRNSTYTTGSYLFENIVLNFANSKTELSQWIDFDIRDFFYYLSSAILNSVYDPKGYQGDLNTFTFSEKIAISKKADWAYEKAKEAVYAETNEKDQQKAINKWREIFGPDFPTYG

SEQ ID NO: 4976 - protein, 330 aa, Sediminibacterium sp.
MAKSVNQAFEEFNKDVVNLMKDNTDNARSSRDWLITQLLAFPKNVDDFPNDYPDKHIKFGSFARNTKIRPLDDIDLMYCLGAGNAYYQIDNYENKKYHIHTENAIDSLKKLSNDDYTLNSIKVVNKLVKALEKVPQYSNSDIKRNQEAAALNLVSYSWSYDIVPCFYTVNNFYLIPDGSGNWKASNPIKDQENIKDTNLNYGGKVYQLVRTLKYWNANFASPKINSYLFEVLVLNNVKSKRSQNNFNDINIKDFFYYLYSNIRYDVQDPKGIQGNINNLTSEQRDRISNKAKYCYDTATIALDFEIEKKNQEKAIENWKIIFGDKFPSYV

SEQ ID NO: 4977 - protein, 330 aa, Wenyingzhuangia marina
MAKSVNQAFEEFNKDVVNLIKDNTDNARSSRDWLITQLLAFPENVEDFPNDYPEKHIKFGSFARNTKIKPLDDIDLMYCIGAGNAYYQIDTYDNKKYYIHTENAIDSLKKLSNDDYTLNSIKVVNKLVKALETVPQYSNADIKRNQEATVLNLVSYTWSYDIVPCFYTVNNFYLIPDGSGNWKASNPTTDQDNIKNTNQNYGGKVYQLVRTLKYWNANFTSPKIGSYLFEVLVLNFVKSTGSQNDFNDINIKNFFYYLYSNIRYDVQDPKGIQGNINNLTSEQKDRISSKAKSCYDTANIALDFEIEKKNQEKAIENWQIIFGDKYPSYE

SEQ ID NO: 4978 - protein, 330 aa, Chryseobacterium vrystaatense
MARSVNQAFEEFNINTVNLIKENTDNARSSRDWLIDQLINFPENIEDFPKDHPEKHIKYGSFARNTKIRPLDDIDLMYCLHASHAYYSVDIFDKSKYYIHTQNSSDELKNLSDDANILSSIKVVNKLVKALNTVPQYSNSEIKRNQEAAVLNLTSYSWSYDIVPCFYTVHNFYLIPDGSGNWKATNPVIDHDNIKNTNQTYGGKVYQLVRTLKYWNMNFVSPKIGSYLFEVFIINFVKYQGTQNDFNDINIRNFFNYLYQNIFYDVNDPKNIQGNINNLTTEERAKISKKAKESYDYAIKAVDFEINETNQEKAIENWRNIFGEKFPKYE

SEQ ID NO: 4979 - protein, 527 aa, Scytonema sp.
MVSKSNTKAESQKSKARTAASSKKTVIEPKIQEANNAKSTAKRARSKQTDDPALKTQATKKVKSPNAKASSTTIKPTKQANSKTKVLPTKRAKAAGKSSSTTNKRTQKVVEQTDIKPTEQPTFSAGKASSTGSQSLSKSKVQPIQKAKFSTAKTRQKKKKSSFENKFISEPEVDRKSGRKANLDLKASTVKAAFKKFQSQIVDLERSTTEKGRTSRDYLFKQVKKLVKNHSDFPPLKGNYIPFGSFARKTKIRPLDDIDILLLLNGRGINVEISYQQKASGYGVNMTAVCRVKITDARSPLQAFADNKGYVNSIKILNRIKHHLAYVTNYLKADKNRRMQAVTLNLKSHPWIFDIVPAIPIHDYRDKVTHFLIPDGYGNWIRTNPKIDAQSITSVNTQHKGELLPVLRLLKYWNERKHKPSLSSYYFETLVVKTFQYAPRITSYPAALEYFFQHCSSFIISSCPDPKRLGEALDANVSWDTKQKIITALRNAANHASHAIIAESKNDQKTAIYWWKKVFGSEFPDYG

SEQ ID NO: 4980 - protein, 327 aa, Scytonema sp.
MVDLERSTTEKGRTSRDYLFKQVKKLVKNHSDFPPLKGNYIPFGSFARKTKIRPLDDIDILLLLNGRGINVEISYQQKASGYGVNMTAVCRVKITDARSPLQAFADNKGYVNSIKILNRIKHHLAYVTNYLKADKNRRMQAVTLNLKSHPWIFDIVPAIPIHDYRDKVTHFLIPDGYGNWIRTNPKIDAQSITSVNTQHKGELLPVLRLLKYWNERKHKPSLSSYYFETLVVKTFQYAPRITSYPAALEYFFQHCSSFIISSCPDPKRLGEALDANVSWDTKQKIITALRNAANHASHAIIAESKNDQKTAIYWWKKVFGSEFPDYG

SEQ ID NO: 4981 - protein, 384 aa, Scytonema sp.
MQKAKFSTAKTRQKKKKSSFENKFISEPEVDRKSGRKANLDLKASTVKAAFKKFQSQIVDLERSTTEKGRTSRDYLFKQVKKLVKNHSDFPPLKGNYIPFGSFARKTKIRPLDDIDILLLLNGRGINVEISYQQKASGYGVNMTAVCRVKITDARSPLQAFADNKGYVNSIKILNRIKHHLAYVTNYLKADKNRRMQAVTLNLKSHPWIFDIVPAIPIHDYRDKVTHFLIPDGYGNWIRTNPKIDAQSITSVNTQHKGELLPVLRLLKYWNERKHKPSLSSYYFETLVVKTFQYAPRITSYPAALEYFFQHCSSFIISSCPDPKRLGEALDANVSWDTKQKIITALRNAANHASHAIIAESKNDQKTAIYWWKKVFGSEFPDYG

SEQ ID NO: 4982 - protein, 365 aa, Oscillochloris trichoides
MVIRQRKSTCTNPSISAILSRVSKQILWSFYMPYTVWGAFDKFRKDCIDLSDTSTKTAIASRDYLFDQIKALAQNNNSFPRLSGGYLKFGSFARKTKIQPLDDIDILVLLNGKGTVSSISPSDPFTYWLKINDENASLATFPDAYGYVDSNKVMYRIRDLLKTISNYSKAEIHKKLNAVTLKLTSYPWVFDIVPAVPINDGQGGIGYYLIPNGLGKWIRTDPRKDSDIITSFNTTHNSKFIPTVRLLKYWNARTHKPRLMSYYIETLAIKVFQYATPINEYHSAVKYFFDNCPLYLNISCPDPKGLGPNLDLNIDQQAKQKVSDAMREATGFIYNASIASNVQDEKTAIYWWGRVFGSSFPSYGS

SEQ ID NO: 4983 - protein, 333 aa, Stanieria cyanosphaera
MVYTVWSAFNRFRTDTVDLAPDVTDRARTSRNYLFDQVKRLANNNADFPRLKGGYLSFGSFARKTKIQPLDDVDILILLNDENTEVQSLYNEPYTYYLKAKNSFAPLYLFTDDYNYVNSTKILNKIKYHLSSISNYKKAEIKKTMQAVTLNLSSYDWVFDIVPAVPAYNYSGSIAYYLIPDGKGKWIKTDPRVDSTNVTKINSRHNGKFLPTLRLLKYWNRRTHKPRLQSYYFETLAIQVFQYASSIDNFPNAIKYFFDNCPFYINQICSDPKNLGTALDLSVPQSTKDKIITAMSEASTFAKYALVYEEKSDNKEAIYWWQRIFGYEFPSYG

SEQ ID NO: 4984 - protein, 333 aa, Calothrix sp.
MPYTVWGAFDKFRKDTVDLDADITKKARTSRDYLFDQLNILARNHSGFPRLAGDYLSFGSFARKAKIQPLDDIDTLIILKGQGTREVQSPSSSFIHWLEVTDRLSPLFIFANEYGYVNSTKVLNRIKIYLSSVSNYKQAEIKKTMQAVTLNLKSYPWVFDIVPAVPVVNGSGKIVYYLIPDGLGNWIRTDPRIDSKNITDVSVKHPNKFLPTIRLLKYWNFRTHKPRLSSYYFETLVIKVFQNSAQINDFPQAIKYFFDNCPYYLRTSCPDPKGLGPNLDASVDSSTKEKVAKAMSEASTWAGYALMYEAQSKHDEAIYWWQRVFGSQFPSYG

SEQ ID NO: 4985 - protein, 294 aa, Candidatus Woesebacteria bacterium
MDSLLAKIRLQDDEIAQVKGAHAHLVEVLNSKASNSTLPTAKDFLLTGSYARDTKITPLDDVDIFYIIGKANSVDSHWHTIIDCDFTFGQEFLDADQNVSSLKILNLIKKEIGETYGKSEIRRDGEVVNLFLTSYGVGFDITPVFEISNDDYYLMPEGKGMHKWKKSNPLIDHAHITHLHEKHNYMLKDIILLAKYWFKRKRIKSPRSYHLESVAYHLFDSIPPGVYTHTGWLSYLLKNINKDNHLISCPDPTGLSEPLSSGLTPEDITNIENEANEAVTHLSQGSDKFIEYVN

SEQ ID NO: 4986 - protein, 327 aa, Lactobacillus hokkaidonensis
MSVDSWFKNYVSENINIDSKKSARARTSRNWLTSNIKDLSQKNEENLELYSDSEFALKMGSFARKTQIRPLDDVDQMIIFSAKGSTANLDTSQWNQVFVNVPDSAPELKKMDGENGLSSIKVLNYLKQLLNGISQYQSADIKRSQQALRLELSSYDWGFDIVPGFRTVDDEQGYYYYIIPNGNGTWEKTDPRIDRQNLTEYQKETPIDLREVVRIIKYWRKAHNAVCKLNSYALETTVLDFIDTNPIYSNSREFIENFLLYLSKAVLGSVQDRKGIQGDLNSLDYIDRLEIQEKAIYYHDMIKEANNYESESMSEQAIKSWTNFFGD

SEQ ID NO: 4987 - protein, 327 aa, Lactobacillus hokkaidonensis; identical to SEQ ID NO: 4986

SEQ ID NO: 4988 - protein, 327 aa, Lactobacillus brevis
MSVDSWFKNYVSENINIDSKKSARARTSRNWLTSNIKDLSQKNEENLELYSDSEFALKMGSFARKTQIRPLDDVDQMIIFSAKGSTANLDTPQWNQVFVNVPDSAPELKKMDGENGLSSIKVLNYLKQLLNGISQYQSADIKRSQQALRLELSSYDWGFDIVPGFRTVDDEQGYYYYIIPNGNGTWEKTDPRIDRQNLTEYQKETPIDLREVVRIIKYWRKAHNAVCKLNSYALETTVLDFIDTNPIYSNSREFIENFLLYLSKAVLGSVQDRKGIQGDLNSLDYIDRLEIQEKAIYYHDMIKEANNYESESMSEQAIKSWTNFFGD

SEQ ID NO: 4989 - protein, 327 aa, Lactobacillus kefiri
MTVDSWFSNYVSENINIDSKKSTGARNSRNWLTSNIKDLSQRNEKNLELYSGSEFALKMGSFARKTQIRPLDDVDQMIIFSAKGSTANLDTPQWNQVFINVPNSAPELKKMDGENGLSSIKVLNYLKQLLNGISQYQSADIKRSQQALRLELSSYDWGFDIVPGFRTVDDGQGYYYYIIPNGEGAWEKTDPRIDRQNLNEYQKEASIDLREVVRILKYWRKAHNAVCKLNSYALETMVLDFIDTNPIYSNSREFVESFLLYLSKAVFDSVQDRKGFQGNLNFLDFTARLEIQKKAIYYHDVIKEANKYETESMSDQAIKSWTKFFGN

SEQ ID NO: 4990 - protein, 327 aa, Lactobacillus fermentum
MTIDSWFSNYVSENINIDSKKSTGARNSRNWLTSNIKDLSQESEENLELYSGSEFALKMGSFARKTQIRPLDDVDQMIIFSAKGSTANLDTSQWNQVFINVPNSAPELKKMDGENGLSSIKVLNYLKQLLNGISQYQSADIKRSQQALRLELSSYDWGFDIVPGFRTVDDGQGYYYYIIPNGEGAWEKTDPRIDRQNLTEYQKKSTIDLREVVRILKYWRKAHNAVCKLNSYALETMVLDFIDTNPIYSNSREFIESFLLYLSKAVFGSVQDRKEFQGDLNSLDFAARLEIQKKAIYYHDLIKEANNYETESMSEQAIKSWIMFFGN

SEQ ID NO: 4991 - protein, 203 aa, Lactobacillus casei
MAKMGSICMNTNSWFENYVSENINIDSGKSIGARKSRDWLTSNIKKLSQSNEENIQLYPGSEFTLKMGSFARKTQIRPLDDVDQMIIFSAMGSSANLETDQWNQVFINVPDSASNLKQMDGDHGLSSIKVLNYLKRLLNGISQYQSADIKRSQQALRLELSSYEWGFDIVPGFRTIDDDKGNYYYIIPNGEGAWEKNGSANRP

SEQ ID NO: 4992 - protein, 264 aa, Lactobacillus acidipiscis
KNSDAKTSRDWLINQIKSLSKSENAIDLYSSEEFTLKMGSYARKTQIKPLNDIDQMIIFSAMGSTANLGSDNWNEQYIYVPTAADKLRKLEGDHGLSSIKVIEQLKSLLKDIPQYQNADINRNQQALRLELSSYDWGFDIVPGFRTIENDAGYYYYLIPNGKGNWEKTDPRIDRENLESYQKSSLINLRETIRILKYWREGHNSVSQLNSYMLETMILDFIDSTEKECDSQRVFIEKFLLYLSTEIQNPVYDRKNFQGDLNILN

SEQ ID NO: 4993 - protein, 281 aa, Lactobacillus acidipiscis
MSIDNWFNDYVSKNINIKSKKNSDAKTSRDWLINQIKSLSKSENAIDLYSSEEFTLKMGSYARKTQIKPLNDIDQMIIFSAMGSTANLGSDNWNEQYIYVPTAADKLRKLEGDHGLSSIKVIEQLKSLLKDIPQYQNADINRNQQALRLELSSYDWGFDIVPGFRTIENDAGYYYYLIPNGKGNWEKTDPRIDRENLESYQKSSLINLRETIRILKYWREGHNSVSQLNSYMLETMILDFIDSTEKECDSQRVFIEKFLLYLSTEIQNPVYDRKNFQGDLN

SEQ ID NO: 4994 - protein, 330 aa, Lactobacillus acidipiscis
MSIDNWFNDYVSKNINIKSKKNSDAKTSRDWLINQIKSLSKSENAIDLYSSEEFTLKMGSYARKTQIKPLNDIDQMIIFSAMGSTANLGSDNWNEQYIYVPTAADKLRKLEGDHGLSSIKVIEQLKSLLKDIPQYQNADINRNQQALRLELSSYDWGFDIVPGFRTIENDAGYYYYLIPNGKGNWEKTDPRIDRENLESYQKSSLINLRETIRILKYWREGHNSVSQLNSYMLETMILDFIDSTEKECDSQRVFIEKFLLYLSTEIQNPVYDRKNFQGDLNILNYSTQASISIKAKDYYNVIENANKLEKQGLDEQAETKWVDFFGHQNN

SEQ ID NO: 4995 - protein, 352 aa, Lactobacillus acidipiscis
  MOD_RES (9)..(9): Any amino acid
MKVPKQTVXIVVLKFLIIGGLLMSIDNWFNDYVSKNINIKSKKNSDAKTSRDWLINQIKSLSKSENAIDLYSSEEFTLKMGSYARKTQIKPLNDIDQMIIFSAMGSTANLGSDNWNEQYIYVPTAADKLRKLEGDHGLSSIKVIEQLKSLLKDIPQYQNADINRNQQALRLELSSYDWGFDIVPGFRTIENDAGYYYYLIPNGKGNWEKTDPRIDRENLESYQKSSLINLRETIRILKYWREGHNSVSQLNSYMLETMILDFIDSTEKECDSQRVFIEKFLLYLSTEIQNPVYDRKNFQGDLNILNYSTQASISIKAKDYYNVIENANKLEKQGLDEQAETKWVDFFGHQNN

SEQ ID NO: 4996 - protein, 438 aa, Candidatus Gracilibacteria bacterium
MKKDKLNIKLREFARNLSPRDSEKKLVKDIYDALKNVLGESNCIQIGSYPRYTSITPMHDLDVLYILGDWNPNSHDPRLVLSDLYNRLISDFDNPTNYEIKISYQTHSITISFQENGEEKFGLDVVPAYKFGKNEFSLDKYKVPEIVNLSHKSRTNKYKRIIKLHEEMGWINSDPRGYIEIAKNLNQSNEDFRKSVKLVKKWKSNLCNIDKELKLKSFHLEQVITKYYLEDNSLTIFDTIFKFFTKLPEIIGEPNQIQDRANSDKFIDDYLEKLTGEQKEKIIQARDCFLINLENITYDKNIGILFDVCFYERSGTDEKFLFDQGIPVFLDSEYKFKIYGEAQQGNGFLKKILDKVGFIENKRKIIFGIIGNRPNVDIFKWKVRNDDNCGEPRGEITDNQTLNYPESTAYGGNHYVECYAILNNTCVAKAKQNVCLNK

SEQ ID NO: 4997 - protein, 441 aa, Candidatus Peregrinibacteria bacterium
MKKDKLNSQFREQARKLSPKIGEQTLISKVYESFNKLLGVNNCIQIGSYPRFTSITPVHDLDILYILGSWDEVNHSPAYALQSLYDQIERDYENPTDYNIEAGLQTHSVTITYYHNGKEILSVDIVPAFKYSKNEFQQDTYKVPEVLKKKHGERRNAFYKELSEAHKQMDWIISDPRGYIKVATDTDQTSKGDFRKTVKILKAWKMNLAEHNENLKLKSFHIEQIITKYFQENSGLEIFDAIFGFFIDLPSIIENPNKIADRANNGKFIDDYLAKLTINQKQQIIKARDHFLMQLEEITDTNQFSTLLHVDFYVRKNEEKFLFDFGIPVCIDDTLSFEIDGYLRKKDGFREYAYKISTNGGRVGKKNSIKFRIEANSTSANQYKWKVKNDNSCSQPRGEITDGKTRNDPESTAYAGNHHVECFAIIDNLCIARSKQDVIIS

SEQ ID NO: 4998 - protein, 442 aa, Flavobacterium johnsoniae
MKKDKISSLIRTYVREKLSPTMSDIQFVSKIYQSFNDLLGVNNCIQIGSYPRYTAIRPLHDLDILYILGDWQSSNIEPFSDLNNLADKFEKEYKNPTKYNIEITVQTHSISFRYLDDKIEVFAVDLVPALKKDQNEFKKDMFYVPEIIKQNRGQKRQEYYRTKQLNNSKIIWIKTDPLGYIEVATSLNQINEDFRKSVKFVKGWKHNCKEKNDDFKLKSFHLEQLITRDYLINPYQDIFESIFTFFTSLKKNIEQPNIPDRANANKCIDEYLSELSENQYKIINEAIDAILIALENIDLNPCIRSIIDSGFYKRKSETETYLFDQKIPILIDSSLKLDIDGFVEKFDGFRKFKANLKLANGIVDNKNSIEFKVIQNTTNAEILKWKVKNDNNSPEPRGEITDHNTYQKVETTAYLGSHYVDCFAVKNNICIARDRVNVIVKN

SEQ ID NO: 4999 - protein, 443 aa, Flavobacterium gelidilacus
MNRNKINALLRGYIKENLTPTAEDIQFVSNIYQSFNDLLGTNNCVQIGSYPRYTAIKPLHDLDILYIMGDWNSNTINPVFNLQTIANKFSKEYKNPTGFNLDIIVQTHSISFRYLNNKGEEVFAVDLVPALADGKNEFDRNTFRVPEIIKIHRGKRRKQYYERKIQNKENLLWIKTDPLGYIEIASAINKENKDFRRSVKFVKRWKHECKLKNENFKLKSFHMEQLITENYKLNMELDLFDSIFKFLVELKEKIEKPIIKDRGDKNKFIDSYLEDLTKVERELINQAVDAILISFENIDNINDIEVIIESGFYKRVSESERFLFDQKIPVLIDFTLDFKIDGFVKKLSGFREYKANLKNVRGIVDTKNEIDFKVISNTTSCELLKWKVKNDNQNSEKRGEITDHSTRCNPEKTAYIGHHFVECYSIKNNTCIARDMVDVVVRQ

SEQ ID NO: 5000 - protein, 442 aa, Aequorivita viscosa
MKKNKINSTLRKFVKEHLSPTQDDIKFVSKIYQSFNELLGTQNCIQIGSYPRYTAIRPLHDLDILYIIGNWEHLKTIPENLLSNLARRFKQEYKNPTHYSITITVQTHSISFKYMNGENEVFAVDLVPSLVNSKNEFGLDTYYVPEIIKYQRGQKRLEYYQRIKEKHSQINWIKSDPRGYIEVASRLNSKNEDFRKSVKFVKGWKNYCKEQNENFKLKSFHIEQLITINYLKNSSIEIFDSVFLFFTKLKDDIKAPKIKDRADNTRYIDEYLNELTESETNLINEAVDSILIAFENINSETKFEDLINCGFYKRIRETEKFLFDQNIPTLIDESLVFEVDGFIEKYDGFRKYNASLKKSSGIVDTKNHISFKVVNNNTYCDLVKWKVQNDRNSEQPRGEITDYKTHQNPENTAYIGKHFAECYAIKNNICIAKDRVNVIVKK

SEQ ID NO: 5001 - protein, 439 aa, Candidatus Pacebacteria bacterium
MIKPEINELLRQYVRDNLSPDEKDRTFVSNIYDSFTELLNNNCIQIGSYPRFTSIRPLHDLDILYILGQWNQYAHNPQSALSKLFESVKADYKNPTNYTVKVSLQTHSVTVAYMDGDKEIFSVDIVPAYIFSKNEFQLDTYKVPELLRKRHGNKRNEFYQQLAIQGREMGWIDSDPRGYIKVASDINKSNNDFRKSVKFVKAWANSYKEEYDDFKMKSFHIEQLITIQYKLNSNLEIFDAIFNFFLQLPDSFSRPQITDRADSTRYIDDYIKDLTQAQRDLILEARNQFLSQLESIYFDVEIEDLLQPVLYTRLPSEDFLFDRQIPTLTETTMTIEGWIQKNGNDFRRLTQQGFIDNGLKIKFRLHMGVDCDEYWWKVKNDNNCEQPRGDITVGNTKNVPEDTKYPGNHYVECYAIRDGICVAKARQNVVIKHQSKKYY

SEQ ID NO: 5002 - protein, 295 aa, Acetobacter syzygii
MWIAVRQRFRQFVSDLNPTTEQVDDAFGKARRIGQALQRAYGEEATETPPIFAVGSWGKGTQVRPSTDIDIMVRFDRSTLERFQAYAFNGQSAFLQEIKGKLETSYPQTRKRGDGQVVQIDFNSITVELVPVFPIGNGQFIMPDTNGGGSWKTVDPIAQIQLIDKTDRDYNGNVRPLCKIIKRWKHECSVDLKSFVIELLIVDFFRNYTFGKYDYYWYDFYVRDCLKFFKNRVNGWVSIPGTGEIIQLGDKWAAKVDAAIAIAETACNYERDDLYILAGMEWQKIFGPRIPIHVM

SEQ ID NO: 5003 - protein, 306 aa, Acetobacter syzygii
MLVILRFWRINLWIAVRQRFRQFVSDLNPTTEQVDDAFGKARRIGQALQRAYGEEATETPPIFAVGSWGKGTQVRPSTDIDIMVRFDRSTLERFQAYAFNGQSAFLQEIKGKLETSYPQTRKRGDGQVVQIDFNSITVELVPVFPIGNGQFIMPDTNGGGSWKTVDPIAQIQLIDKTDRDYNGNVRPLCKIIKRWKHECSVDLKSFVIELLIVDFFRNYTFGKYDYYWYDFYVRDCLKFFKNRVNGWVSIPGTGEIIQLGDKWAAKVDAAIAIAETACNYERDDLYILAGMEWQKIFGPRIPIHVM

SEQ ID NO: 5004 - protein, 295 aa, Bosea sp.
MWLAVRQRFRQFHSDLNPTPGEVGDALGKAFRVGQALERAYGGQATDNPPIFQVGSWGKGTQVRPSADIDIMARFDRSVFERFHAYANNGQSSLLQEIKGKLEPTYSQTRMRGDGQVVQIDFNSIMVELVPVLPVANGQFIMPDTNDGGSWKTVDPAAQIRHIDEADRAYNGNVRPISKMIKRWKHECNVELKSFAIEILVVEFFRGCPWPHHDHYYHDWYVRDCLKHMRSRLNGWISVPGTGEFVSLGNDWATKVETAIGIAEKACDYEYRDLDVLAGVEWQKIFGPRIPLRIL

SEQ ID NO: 5005 - protein, 295 aa, Methylobacterium brachiatum
MWVAVRQRFRAFHEDLNLTRDQVEDGIGKAIRVTQALERAYNGRVADQPPLRIVGSWGKGTQVRPSADIDIMVEFTPAVLARFEARVGNRQSQLLQEVRASLLDAYPQTDMRGDGQVVMVQFNTITVEVVPVFDLPGGQYLMPDTNNGGRWKTVDPLAQIALIEAIDTRTNGNTRALTKIIKMWQREKNVPLKSFLIELLVADFMSTYQYAQQDYYYYDWFVRDFLRALVGRAGSGLLVPGTGEWIWLGADWHTKAEAALAVAETACEWERLDYDVTAGQEWQTIFGARIPIHVL

SEQ ID NO: 5006 - protein, 296 aa, Methylobacterium sp.
MWKAVRERFKRFSDDLQITPTQLEDGVNKHLNVGRILERGYYEREPSSAPPGLLVGSWGKSTQVRPSNDIDSFFILPDAVKTRFDARTGNIQSQLLQEVRAVLAETYPQTSIRGDGQVVVVGFNTNTLEIVPVFRADGAAFTMPDANDGGRWKNVDPRAQITQIESTDRSMNGNVRALAKIMKHWRNEKNVPLKSFVIELLVSEFLPARGHGGYDTFWYDFYVRDFFQYLCSKANGYIIIPGTYEIYGLGNEWLGRAEIARDIAIQACQWEYHDYDVTAGQEWQKIFGTRIPIHVV

SEQ ID NO: 5007 - protein, 295 aa, Mesorhizobium mediterraneum
MWVAVRQRFKRFVDELSLTDDQFNDGWTKHINIGRTLERAYYGTNGEFPPAFMVGSWGKQTQVRPPRDLDAFFVMPQHEKARFDARAGNVQSALLQEVKEALRVTYPNTEMRGDGQVVAIAFNTITVEVLPVFATEYRQYWMPDTHDGGSWKVVDPFAQIGAIETADKAMNGNVRALSKMMKLWKRERNVPLKSFVIELLIAEFLPARGYGGESTFWYDYYVRDFLSFLISKANAVITIPGTFEPYFLGSEWLPKAIAARDIALAACHWEYSDFTVSAGQEWQKIFGPRIAVHVT

SEQ ID NO: 5008 - protein, 332 aa, Ochrobactrum grignonense
MGSRIIQKLFVGDRCYSQVQTKFLPLYLAGLRGAIRMWIGVRQRFRRFHDGLKLSKDQLDDGVGKQLGVRKSLHRAYYSEASDNPCGFIVGSWGKGTAVAPPSDVDIFFELPVAVYHRFEAYQGNKQSALLQEVRENLSNTYPQTTMRGDGQVVIVGFNTITVEVVPAFRYDNSGRFYMPDTNDGGRWKMVDPLAEIAYIDAADLNAFGNVRPMAQMLKTWKRHCNVPLKSYQIELLVAEFMPSYVYRHQDYFYYDWFIRDFLIWLCNKAWTNQTIPGTLELVNLGDTWLSRAQTARDRAIRACEHEHEDYTILAGEEWQKIFGDRIPIHVL

SEQ ID NO: 5009 - protein, 296 aa, Ochrobactrum grignonense
MWIGVRQRFRRFHDGLKLSKDQLDDGVGKQLGVRKSLHRAYYSEASDNPCGFIVGSWGKGTAVAPPSDVDIFFELPVAVYHRFEAYQGNKQSALLQEVRENLSNTYPQTTMRGDGQVVIVGFNTITVEVVPAFRYDNSGRFYMPDTNDGGRWKMVDPLAEIAYIDAADLNAFGNVRPMAQMLKTWKRHCNVPLKSYQIELLVAEFMPSYVYRHQDYFYYDWFIRDFLIWLCNKAWTNQTIPGTLELVNLGDTWLSRAQTARDRAIRACEHEHEDYTILAGEEWQKIFGDRIPIHVL

SEQ ID NO: 5010 - protein, 270 aa, Sinorhizobium fredii
MGKQLGVRKSLHRAYYQESTGNPRGFIVGSWGKQTAVAPPSDVDIFFELPVEVYHRIESYQGNKQSALLQEVRGHLLTTYRQTNMRGDGQVVIVGFNTITVEVVPAFRYDNYGRFYMPDTNNGGQWKLVDPKAEIAYIDAADQNASGNVRPMAQMLKTWKRHCNVPLKSYQIELLVAEFMPNYVYRHHDHFYYDWFMRDFFIWLCNKAWANLTIPGTFELFNLGDAWLSRAQTARDRALRACDDEYNDYTISAGEEWQKIFGDRIPIHVQ

SEQ ID NO: 5011 - protein, 296 aa, Pseudochrobactrum sp.
MWIGVRQRFRRFHEELRLSADQIDDGLGKQLGVRKSLHRAYYDETTETPRGFIVGSWGKETAIAPPSDVDIFFELPTAVYHRIETYQGNKQSALLQEVRGHLLTTYPQSSIRGDGQVVIVGFNSVAIEVVPAFRYDNNGRFYMPDTNDGGRWKLVDPQAEIAFLEAADRNSNGNARAMAQMLKTWKRECNVPLKSYQIELLVAEFMTSYENRYYDYYWYDWFMRDFFAWLCTKAWANLTIPGTFELVNLGNDWLSKAQTARDRALTACSHEYNDYTILAGEEWQKIFGNRIPIHVL

SEQ ID NO: 5012 - protein, 296 aa, Rhizobium leguminosarum
MWVGVRRRFREFHESLQLSDNQRDDGNGKQLGVRSALHRAYYDESTDNPKGFVVGSWGKGTAVAPPNDVDIFFELPVDVYHRFESYIGNKQSALLQEVRGHLLATYSQTSMRGDGQVVIVGFNTITVEVVPAFRYDDHGRFLMPDTNDGGRWKTVDPLAEIAYIDLADRQSSGNVRPLAQMLKIWKRERNVPLKSYQIELLVADFLPTYAYRQHDYFYYDWFMRDFFTWLCSKAWADFVLPGTFETINLGNEWLSKAETARACAEQACGYEHDDLTILAGEEWQKIFGGRIPIHVL

SEQ ID NO: 5013 - protein, 332 aa, Unknown
  Description of Unknown: Parcubacteria group bacterium sequence
MNSLFSLQSAASILYPQQQNTLAALAGLTVPAISSPPRWIAVRQRFEQFHSNLGLTQLQQLDGYTKRSGVVSCLNRVYYGAADDNANSFFIGSWGKDTAIRPPRDVDVYFVLPVNVYQRFQGYIWNRQSALLQEVKASLSTTFPNTDISGDGQVVLVNFASYNVEVVPAFTLTTPGHYWICDTNNGGSYKETAPWAEAQHITDSDTANAGNLRPLIRMLKAWQACCAVPIKSFQIELLSASFLAQSPWRHKDWFYFDWLTRDFFAFIYHRANTSIIVPGTFESIALDNAWQSRAATAYYRAVRACEYEYANRVAEAGDEWQKIFGTDVPRMP

SEQ ID NO: 5014 - protein, 263 aa, Burkholderia sp.
MVSCLNRAYYGTNSGTDHSFFVGSWSKDTAIRPPRDVDVYFQLPVEAYHRFQGYVWNRQSALLQEVKGRLAQTYPNTDMSGDGQVVLVNFGSYSVEVVPAFELTTPGRYWICDTHNGGSYKQTAPWDEVITLEASDSANARNLRPLIRMLKAWQARCSVPIKSFHLELLASEFIAQSVWRLQDWFYFDWIVRDFFAFLYHRANGFVFVPGTGEAMALGDDWQSRAESAYRRAAKACECEYQNRVTDAGDEWQKIFGIDIPRVA

SEQ ID NO: 5015 - protein, 262 aa, Burkholderia vietnamiensis
MNCLNRAYYGANSDTDHSFFVGSWSKGTAIRPPRDVDVYFLLPADVYYRFQTYSWNRQSALLQEVKARLAQTYWNTDISGDGQVVLVNFGSYSVEVVPAFELTTPGRYWICDTHNGGSYKQTAPWDEVRALEAADAANARNLRPLVRMLKAWQANCSVPIKSFHLELLAAEFIAQSPWRLHDWFYFDWIVRDFFAFLYHHANGFVFVPGTWEVMMLGDDWQSRVASAYNRAAKACEYEFQNRVTDAGDEWQKIFGSSIPRVV

SEQ ID NO: 5016 - protein, 262 aa, Burkholderia ubonensis
MNCLNRAYYGANSDTDHSFFVGSWSKDTAIRPPRDVDVYFLLPADVYYRFQTYSWNRQSALLQEVKARLAQTYWNTDISGDGQVVLVNFGSYSVEVVPAFELTTPGRYWICDTHNGGSYKQTAPWDEVRALEAADAANARNLRPLVRMLKAWQANCSVPIKSFHLELLAAEFIAQSPWRLHDWFYFDWIARDFFAYLYHRANGFVFVPGTWEVMMLGDDWQSRVASAYNRAAKACEYEFQNRVPDAGDEWQKIFGSYIPRVV

SEQ ID NO: 5017 - protein, 306 aa, Burkholderia ubonensis
MLPPPPIYRLPHWVAVRQRFEQFHRNLALTPLQQRDGFAKRAGVVNCLNRAYYGTASDTDHSLFVGSWSKDTAIRPPRDVDVYFLLPIDVYHRFQAYTWNRQSALLQEVKAKLAQTYWNTDISGDGQVVLVNFGSYNVEVVPAFELTTPGHYWICDTNNGGSYKETAPWAEVSALDAADSANAQNVRPLVRMLKAWQANCSVPIKSFHLELLAAEFIAQSQWRLYDWFYFDWIVRDFFAFLYRRANGFVFVPGTYEVMMLGNDWQSKAESGYRRAAKACEYEYQNRVTDAGDEWQEIFGCDVPRVV

SEQ ID NO: 5018 - protein, 306 aa, Burkholderia ubonensis
MLPPPPIYRLPHWAAVRQRFEQFHRNLALTPLQQRDGFAKRAGVVNCLNRAYYGTASDTDHSLFVGSWSKDTAIRPPRDVDVYFLLPIDVYHRFQAYTWNRQSALLQEVKAKLAQTYWNTDISGDGQVVLVNFGSYNVEVVPAFELTTPGHYWICDTNNGGSYKETAPWAEVSALDAADSANAQNVRPLVRMLKAWQANCSVPIKSFHLELLAAEFIAQSQWRLYDWFYFDWIVRDFFAFLYRRANGFVFVPGTYEVMMLGNDWQSKAESGYRRAAKACEYEYQNRVTDAGDEWQKIFGCDVPRVV

SEQ ID NO: 5019 - protein, 306 aa, Burkholderia ubonensis
MLPPPPIYRLPHWAAVRQRFEQFHRNLALTPLQQRDGFAKRAGVVNCLNRAYYGTASDADHSLFVGSWSKDTAIRPPRDVDVYFLLPIDVYHRFQAYTWNRQSALLQEVKAKLAQTYWNTDISGDGQVVLVNFGSYNVEVVPAFELTTPGHYWICDTNNGGSYKETAPWAEVSALDAADSANAQNVRPLVRMLKAWQANCSVPIKSFHLELLAAEFIAQSQWRLYDWFYFDWIVRDFFAFLYRRANGFVFVPGTYEVMMLGNDWQSKAESGYRRAAKACEYEYQNRVADAGDEWQKIFGCDVLRVV

SEQ ID NO: 5020 - protein, 221 aa, Burkholderia ubonensis
MLPPPPIYRLPHWAAVRQRFEQFHRNLALTPLQQRDGFAKRAGVVNCLNRAYYGTASDTDHSLFVGSWSKDTAIRPPRDVDVYFLLPIDVYHRFQAYTWNRQSALLQEVKAKLAQTYWNTDISGDGQVVLVNFGSYNVEVVPAFELTTPGHYWICDTNNGGSYKETAPWAEVSALDAADSANAQNVRPLVRMLKAWQANCSVPIKSFHLELLAAEFIAQSQ

SEQ ID NO: 5021 - protein, 477 aa, Burkholderia ubonensis
MLPPPPIYRLPHWATVRQRFEQFHRNLALKPLQQRDGFAKRAGVVNCPNRAYYGSASDTDHSFFVGSWSKGTAIRPPRDVDVYFLLPVDVYHRFQTYTWNRQSAILQEVKAKLAQTYWNTDISGDGQVVLVNFGSYNVEVVPAFELTTPGHYWICDTNNGGSYKETAPWAEVSALDAADSANAQNVRPLVRMLKAWQANCSVPIKSFHLELLAAEFIAQSQWRLYDCFYFEWIVRDFFAFLYHRANGLVFVPGTYEIMMLGKAKRNRAIVARRKPASMNIKTRHRRRRRVAKNLWLRRSAGGVMEERTQQLIAECKRQQESCEYTSTAIIEWLKRLRLLRLAFVVVPIVLGGLATWPLLAQAKEYQWVTGLCALLAGLARAVYKALHLDVSIEALGKSEHQFRILRDRFRQAWCVAALGPYEDFKAEFDKLMDRMDTAREGSVAVPDRFFNKGRAKIERGDYRFNVDQDRPLEKVAS

SEQ ID NO: 5022 - protein, 306 aa, Burkholderia pseudomallei
MLPPPPIYRLPHWAAVRQRFEQFHRNLALTPLQQRDGFAKRAGVVNCLNRAYYGTASDTDHSFFVGSWSKDTAIRPPRDVDVYFLLPVEVYHRFQAYTWNRQSALLQEVKAKLAQTYWNTDISGDGQVVLVNFGSYNVEVVPAFELTTPGHYWICDTHNGGSYKETAPWAEVSALDAADSAHAQNVRPLVRMLKAWQANCSVPIKSFHLELLAAEFIAQSPWRLYDWFYFDWIVRDFFAFLYHRANSFVFVPGTYEVMMLGNDWQSKAESGYRRAAKACEYEYQNRVTDAGDEWQKIFGCDVPRVV

SEQ ID NO: 5023 - protein, 250 aa, Burkholderia ubonensis
MATDHSFFVGSWGKDTAIRPPRDVDVYFLLPVDVYYRFQAYAWNRQSALLQEVKANLAQTYWNTEISGDGQVVLVNFGSYKVEVVPAFQLTTPGRYWICDTHNGGSYKETAPWAEVSALEDTDNANARNLRPLVRMLKAWQANCSVPIKSFHLELLAAEFIAQSPWRLYDWFYFDWIVRDFFAFLYNRANGFVFVPGTFEAMMLGNDWQSKTESAYRRAAKACEFEYQNRVADAGDEWQKIFGLDVPRVM

SEQ ID NO: 5024 - protein, 404 aa, Variovorax boronicumulans
MSQPPDPSIDLAKILIAHSNSLRDQSLGGLLAPTPQAAPPQPGLGALGIFAAQHAPAPAPGLGLGALSIFAAQQTPASVPGLGLLDGLPLASIMATNALNAPTAADRKWIHLIARFEAFLGNLRLTPNQFTDGQKKFAGVVSCLNNAYYGHNSSTANAFFIGSWAKDTQVRPPRDVDLYFVLPYEVYVRYEGYASSLNKQSALLQEVKGKLAATYGATEIRGDGPVVLAGFWSYDLEIVPAFKLQEDRAYWVCDTKNGGSYMTTKPLHEVDHIRWADGRTSGNARNLVRMLKAWQAECSVPIKSFYLELLAIEFLDQSEWKNNDLFYYDWICRDFFKWMIGKAGSFVIAPGTYQTLWLGDGWKSRAESAYGRALKACEQETKNRMTEAGDEWQKIFGADIPRYV

SEQ ID NO: 5025 - protein, 280 aa, Pandoraea pnomenusa
MTEAQTTDGEKKFKGVVSCLNQAYYGTNSETDHAFYIGSWAKKTRVRPPRDVDLYFLLPVDVYHRFERYAAGVNKQSALLQEVKSKLAATYSKTELKGDGPVVYAGFWTFDLEVVPAFALTEDRAYWVPSTKNGGKYMKTMPLHEVDVIDEADKRNNNNVRPLVRMLKCWQDHCSVPLRSFYLELLSIEFLNQWQHRDQSFFYYDWMCRDFFNWVITKANTYLFAPGTYETLWLGDAWKSRAETALSRARKACDFERDSKEGDAGDEWQKIFGSNIPKWV

SEQ ID NO: 5026 - protein, 281 aa, Burkholderia territorii
MTDLQIEDGVANVCGVVSCLNAAYYGSNSPTDNAFLIGSWAKGTRVRPPRDIDLYFVLPIEVYNRFAGYSAGVNRQSALLQEVKAKLLASYPTSSIKGDGPVVLAGLTSYNVEVVPAFLYSQEERSYYVCDTTNGGSYRKTMPWHEIDTINAADARTSNNARRLIRMLKAWQSWCSVPIKSFYLELLAIEFLDQCPWRNNDYFYYDWISRDFFKWMITKANTYLLAPGTYDLLRLGEAWKSRAESALARAEKACIYEESNDMANAGDEWQKIYGTDIPKWV

SEQ ID NO: 5027 - protein, 302 aa, Herbaspirillum rhizosphaerae
MAFPPSLSWRYVTRRFTQFLSNIELTTHQITDGQRKCRGVIACLNWAYYGHGSETENAFLIGSWAKGTRVRPPRDVDLYFLLPAAVYHRFETYQGYRQSALLQEVKGKLLAKYPGSAIKGDGPVVLAAFESFSIEIVPAFALTEEHAYFVCDTKDGGAYKKTRPGDEAVAINTADQRNANNVRPLIRMLKVWQDWCSVPIKSFYLELLAIEFLDQCAWRHQDHFYYDWICRDFFEWMVKKANTYLVAPNMSELFWLGNDWKSKAESAYRRADLACGFERDNAMNDAGEMWQMIFGPNIPRNP

SEQ ID NO: 5028 - protein, 303 aa, Methylobacterium radiotolerans
MSQQTNALQWQYVIRRFSRFLDNITITANQLADGTTKHQGVRSCLNSWYYGYASDEDNSLLIGSWGKETRVRPSRDVDILFLLPMSEYHRFQERSGNRQSQLLQEVKDVLGKTYSQTAMRGDGQVVVVPFNTTPIEVSPGFRMYDGSILGCDANGGGRYVTSTAEAEAADLGLSDRLYDGSTRHLARMFKQWQRHCNVPLKSFWIERLAVQFMSTYQHASQSFFYYDWFCRDFLEYIIRQANGSIIMPGTYDVIWIGDDWLSKARSAHANALRACEHERENSNILAGLYWQDIFGTMIPSDAA

SEQ ID NO: 5029 - protein, 367 aa, Bradyrhizobium sp.
MPLPTDNPFNVLLSLSTSSSSPLGSLYGASEQSANAGIFGSGLNGPFGLPAPTSHVNALTPFLTPPSIPPHLWFYVVRRFQAILNNIAVTTAQREDGEKKHAGVRSALNRHYWNVASDTANSLLIGSWGKDTRVRPSRDVDILFLLPPSVYRQYQSRTGNRQSALLQEVKEVLRTTYSQTATLRADGQVVLLPFNTMPVEVAVGFRCTDGSIIYCDTNDGGSYKTSTAEAEVADLRTTDLTCNANVLPLARLMKQWQRECNVPLKSFQIERLAVEFLRSWSYRHHSLFYYDWMVRDFLGFIIGRANTTLFMPGTFEAVPLGDAWLSRAQTAYKNAVSAADNEYGNYEALAGQDWQKIFGAAAPVLVS

SEQ ID NO: 5030 - protein, 367 aa, Bradyrhizobium mercantei
MPLPTDNPFNVLLSLSTASSSPLGSLYGASEQSANAGIFGSGLNGPFGLPAPTSHVNALTPFLTPPSIPPHLWFYVVRRFQRILNNIAITTAQREDGEKKHAGVRSALNRHYWNVASDTANSLLIGSWGKDTRVRPSRDVDILFLLPPSVYRQYQSRAGNRQSALLQEVKEVLRTTYSQTATLRADGQVVLLPFNTMPVEVAVGFRCTDGSIIYCDTNDGGSYKTSTAEAEVADLRTADLTCNANVLPLARLMKQWQRECNVPLKSFQIERLAVEFLRSWSYRHHSLFYYDWMVRDFLGFIIGRANTTLFMPGTFEAVPLGDAWLSRAQTAYKNAVSAADNEYGNYEAPAGQDWQKIFGAAAPVLVS

SEQ ID NO: 5031 - protein, 313 aa, Nitratireductor aquibiodomus
MNMPGLAPFPLSNVFAPHPWFYVTRRFQHLQGNLALLPADIEDANTKVGGIVSSLNRSFYGESVVSRYLVAGSWGKNTAIRPPSDVDIFFILPNEVFHRFNARTGNKQSQLLQYVRDVVSTTYPQTRIRGDGQVVVVGFNSIEIEIVPAFIAQGGGFIICDANDGGRWKLVNPAGEASALDQSDMAFNGNVRKITRILKQWKRHCNVPIKSFQVEQLVRESLPGMIWGGYQEFWFDWIVRDVFAYMIGRAGGGFYMPGNPGEWINLGDDWKSKAISAYERACKACACERQNLNMAAGSEWQKIFGNAIPETVI

SEQ ID NO: 5032 - protein, 313 aa, Rhodobacteraceae bacterium
MNGLGFAPSLISNSAEPLRWFYVTRRFKALQANLALPPAAIEDANTKARGVIKSLNRFFRDESIVGHYVVAGSWGKTTAIHPSTDIDLCFILPVEVYHRFNAYSGHKQSQLLNHVKDVLTTTYPQTAIRQDGQVVVVGFNSITVEVVPSFLAADRGLITCDTNNGGRWKQVDPLAEIGILDQSDNTLRGNHRKLVRIFKQWKRHCNVPIKSFHLEQLIGEALPRMSWGSHDEFWFDWIVRDVFAHMTARAGGGFFMPGGINEWIDLGDAWKSKAETAHQGALKACEYERENLNLLAGSEWQKIFGTVIPEMVI

SEQ ID NO: 5033 - protein, 292 aa, Candidatus Taylorbacteria bacterium
MTVGSRFEKFLAALMLTSDQQSDGSTKHTGVRQCLDAHYYGSYYAGNGFLVGSWGKSTEIRPPRDIDIMFALPKEVYDRFQTRPGNKQSQLLQEVKAVLQRTYQNTEMRGDGQVVVVPFVSYAVEVAPAFFLQNGQYFICDTNAGGSYKTVDPKAEIANVKQSNDTTNGNTRDLIRMMKRWQEYCNVELRSFLIELLSIEFLASWQHRGNSTVYYDYMVRDFFYFLKNKSQWSSVTVPGTHESILLGNTGWQSRAETAYDRAVKACEHEAQNRPYSAADEWQKIFGTDIPSG

SEQ ID NO: 5034 - protein, 291 aa, Maribius pelagius
MSVAKRFNQFHSNISLTEAQREAGRQSRRSIVTVLNKKYYSSGSSEGNSKFIGSWGKFTRVRPPRDVDILYELPYSTYTRFIGRTGNIQSQILQEVRSALLASYPSTSIKGSGPIVSVPFSGYKAEMVPAFKLNNNKYWICETTNGGRFKEIDYDTEFEIIKTSDSQSSGATRKLVKFSKRWQAYCSVQLKSFWIELLAVQFMRGWEHRAKGAMYYDWMCRDFLHFLCSKANSYLYSPGTYDMHYISNAWLTKAKAAASAADTACSHEGSNEILAGLYWQDIFGTDIPSKV

SEQ ID NO: 5035 - protein, 308 aa, Phaeobacter gallaeciensis
MHPIFPKVDDNTRKDFHLSVAKRFEQFHNNILLTQTQLDNGSDRRKSVIKALNAHYWNSTSETEHSKFVGSRGKFTSIGPPRDVDVLFWLPPSVYDRFQARTGNIQSQLLQEVKTVLQKKFYSTAVKGDGPVVKIPFTTFNVELIPAFKLDTGNYWVCFTNDGGSYKTAAYDAEKDAISQSNDSCGGKTRELVRMMKKWQEHCSVPIKSFWIELVAIEFLQTWEHRDKGKVYYDYMVRDFLLFLKNKRFGNVYAPGTYESMYLGDAWYSRADTAHQRAIKACSYETSDVGAAGDEWRKIFGNNMPRIP

SEQ ID NO: 5036 - protein, 287 aa, Rhodococcus erythropolis
MSNISLTQIERDEATARSNAVAKKLHDHYYPTRAYTGDTKLLIGSHGKRTRVRPVRDVDMIFRIPPATFTRFNDYASNGQSALLQEIRSVLRTRFPSTNVKGDGPIVLVDFANGHTVEVLPAWHYTNAAEEIDRYWIPHTRDGGSWKLSSYAAEFRNVDDSDRASAGQTRRLIKMMKVWQQYCNVPVKSLCLELRAVRFLATWSNRGKSSNWDDYMIRDFFEELIDRANYYCEIPGITEKCYYGDAWLSKARTALANAQRACSFEAAGDEYNAAVEWRKIFGAQYGF

SEQ ID NO: 5037 - protein, 297 aa, Rhodococcus erythropolis
MSTSSRFEKFVSNISLTQIERDEATARSNAVAKKLHDHYYPTRAYTGDTKLLIGSHGKRTRVRPVRDVDMIFRIPPATFTRFNDYASNGQSALLQEIRSVLRTRFPSTNVKGDGPIVLVDFANGHTVEVLPAWHYTNAAEEIDRYWIPHTRDGGSWKLSSYAAEFRNVDDSDRASAGQTRRLIKMMKVWQQYCNVPVKSLCLELRAVRFLATWSNRGKSSNWDDYMIRDFFEELIDRANYYCEIPGITEKCYYGDAWLSKARTALANAQRACSFEAAGDEYNAAVEWRKIFGAQYGF

SEQ ID NO: 5038 - protein, 297 aa, Rhodococcus sp.
MSTSSRFEKFVSNISLTQIERDEATARSNAVAKKLHDHYYPTRAYTGDTKLLIGSHGKRTRVRPVRDVDMIFRIPSATFTRFNDYASNGQSALLQEIRSILRTRFPSTNVKGDGPIVLVDFANGHTVEVLPAWHYKNVTEGVDRYYIPHTREGGRWKLSSYAEEFRNVDDSDAASSGQTRRLIKMMKVWQQYCNVPVKSLCLELRAVRFLASWSNRGKSSTWDDYMVRDFFEELIDRANYYCEIPGITEKCYYGDAWLSKARTALANAQRACSFEAAGDEYNAAVEWRKIFGAQYGF

SEQ ID NO: 5039 - protein, 292 aa, Unknown
  Description of Unknown: Streptomyces sequence
MATGPRFDRFLDKIRVTTTDLNDANTKVAGVAGKLHSHYYGTAYDGSTKLLIGSYGKQTQVRPPRDVDILFLMPYSEYARYNSYIGNGQSALLQAVKAVLQQRYPTTDKIRGDGQVVVVPFSGGHTVEVLPAWSASNDKFLIPNTHDGGSWKTVDHFAEFANIEASDTASGGDTRNLIKMMKVWQAYCTVPIKSLVLELRAVNFLASWEYRAKGSTYYDWMVRDFLGSLIEYANGQCKIPGIDEKCQYGDAWLSKAQTAYARARKACEYEASDMPYSATEEWQKIFGSQYVG

SEQ ID NO: 5040 - protein, 304 aa, Deltaproteobacteria bacterium
MSWRFVIPHFQNFLDNLELTEKQKKDALEKVANVWSCLHKHYYGHPFIDQKTIRIVGSHAKGTAIRPPSDIDILFVLPSSEFTRINQRTGNVQSQFLQEVKSVLINTFPKTDLSADGQIIKAPFSDYAVEVVPSFLRDDGKYVICDSNAGGRWKITDPNSEIFEIRNTDSLTSGKATHLIKMLKVWKKTCNVEIKTFVLEIAAWSFVRQWPHKHQSLFWYDWMIRDFFGWLLNFKNAPATVPGTGEIIPLGDAWYSRCESAYSRALKACEYEYYDQGDHAGEEWQKIFGTQFSAIEGLLRAMLG

SEQ ID NO: 5041 - protein, 300 aa, Mycobacterium sp.
MGGLVSTYSLFSSFHSRISLKEESQQQGLYRVIQCGEALRRRYFPDSENVSDHITLLGSLVKDTGIEPLLDADVLFRMPAGTYSRFDNYAGNGQSALLQEVRDALQTRYPRTVIRGDGPVVVVSFSEPPAIEVVPAVLLSEGSNIVSARGFVPVTREGGRWEHEDYGAEWTTLNSLDKSVNGQLRRLICYMKVWRRHTGALMKSIVLEMMATAFMSGWDRSQTSYTYDDWLVRDFLKYMVDHYTTTYYTPGTGKAIDTGVGWYVDATNSAEAAANACLHLADDLLYRYYWREVFGSEFGI

SEQ ID NO: 5042 - protein, 312 aa, Flavobacterium psychrophilum
MSTSSRFDTFINNIKLSSTQYDDATTKYNNVCKALHNYYYPNLTYNGSTKFLIGSYGKNTAISPPGDIDVIFKIPYATYERFSKNKTGPRGLLNEIKSILDKTFTTTERIKPNGMVVDVAFTTFNIEVLPAFEWTISDWNGTFTVPDTSIGSTFLPSSIDFGNVGTNYGRWKRIEPRKEINELNNSNTQNKNNTKNLVMMMKQWIVFCSVPIKSVVIERLAIEFLRYYEHNNKSSVYYDYLVRDFLSYLLNKENATVFMPGLNENIQIGSSWLSKTQTASSRAIKACEYEAAKKDFDAAYEWKKIFGNPYYY

SEQ ID NO: 5043 - protein, 447 aa, Candidatus Kaiserbacteria bacterium
MEPVFNDFIHSIKLTKRQRDDAKTKYSGVCRVLHNHYYTDTEYSGKTKLLIGSYGKKTNIRPPGDIDVIFKMPADTYDTYLEKENAQSQLLQDVRGILSKSYTTTEKISAFGKVVVIHFTVGKHNVEVLPGWEQNDGSFIIPNTSNGGSWEHWNPAADITAINASNNESGKTKSLIRLLKKWRVVCGVPLDAFKIEVLVTNHLAYYYNNNVTNIGYDRLLKSFFENLLSIPNSYITTPSGSYAQLGSDWYSRTQSALSRLEKAIKAYEDKDFNECTTELRKIFGDNFPKVEVQKEYLSDTRLSELFKLYPSSEDEFIDKDYSFPIQINPDYSVLIDTRIEEANGFRKGFLLDKLLNSMQFTLPKSASLSFYIKHVDVPQPYSVYWKVRNFGEEAQRKECLRGKITKDEGKYERVESTAYTGIHFVECYIIKNNQCAAIGRIPVPIGS

SEQ ID NO: 5044 - protein, 416 aa, Desulfonauticus sp.
MSIQKQFEQFYEKIKLTSSQREDAKKKYNGVCKKLHDHYYPGTEYNGSTKLLIGSYGKRTNIRPPRDVDVLFIMPDDKFDQYDDNESNGQSQLLQDIKKILSEKYSTTEKIKGWGKVVLVQFADGTHNIELLPAWEKENGKFIIPNTENGGFWETWDPRAEIKKINDSDKKTNGKTRALIRMIKKWSENCSVKLKSFQIEEKVVDFFSSNDSDEEYSILVRDFLGYFYNLVDEKVKSHVKTAHNRAIKACDLENEGKIEEATDEWKKIFGNDFPSVEGSSKSYQEDKPVLADHSHCEPLRWPFEKIYRVGIDAYIYTENKAKRLGGINSDGRVLPPGFYLKFIARTNAKGIFKYYWQVVNTGEAAKRNNDLRGKIFEGSQVQWEHTRYPGKHWIECFIVQGNICVARSGRFFVNIR

SEQ ID NO: 5045 - protein, 417 aa, Candidatus Peregrinibacteria bacterium
MGINDQFIKFYENIKLTSLQRDDAITKYTGVCKKLHDFYYPTIEYNGNTKLLIGSYGKQTHIRPARDIDVIFIMPPEKFNQYDDNQSNCQSQLLQDIKKILEEKYPDTPIKAFGKVVVLEFADTKHDVELLPAWENENGTFKIPNSENGGSWEQWDPRSGIKKIKDSDTDTGKTKTLIRMIKKWSENCTVKLKSYQIENKVLDFFSFNDCTEKEYTEIVKSFFDYFHNTETDENIKSYLATALSRVKKACDFERDEKFDEAIAEWRKIFGDDFPATIEKSIATVEDTKQSLADYSHCEALKWPFSGGYRVGMNAYIYNGTKTTKLGGINSDGRSLSAGLQLKFIANTNVSDNFQYYWQVVNTGQAAKIAGGLRGNFFTDNQVRWESTQYKGKHWIECFIVQNDACIARSGKFFINIK

SEQ ID NO: 5046 - protein, 432 aa, Unknown
  Description of Unknown: candidate division WWE3 bacterium sequence
MNINDQFLKFYENIKLTPAQRDDAVAKHTGVCKKLHDYYYPDSEYNGSTKLLIGSYAKHTHIRPARDIDVIFIMPPEKFEQYNDNRSNCQSQLLQDIKAILAEKYPNTPIRADEKVVVLEFADTKHDVELLPAWENDDGTFKIPNSANGGSWENWNPRSEILKISDSDEATGKTRALIRMVKKWSENCSAKIKSYKIEDGVIDFFTTTDHDLDYPVLVRNFFEYLYNATADQNLRSHLSTAFNRAKKACEFENNDKMEDAVAEWQKIFGDDFYITLEKGVADGIDDKIQKLYLVYPSSKEEYLESKYGIKTSLSSAYSLKIDAEVQQNGFRNNFLSNFILNKLPLLKNKKLIFRVIKNTVPDPFEIKWKVRNFGSEAKDANDLRGEISDDFGSAEKKENTRYMGEHYVECYIIRSNVCVASDRILVPIGRDY

SEQ ID NO: 5047 - protein, 432 aa, Unknown
  Description of Unknown: Parcubacteria group bacterium sequence
MAIQEQFEKFYENIKLTSFQREDAKRKYDGVCSKLHSHYYPNTTYDGNTRFLIGSYGKKTHIRPARDIDIIFIMPPKKFSQYDDNNSDSQSQLLQNIKRVLEEKYPNTPIKAFGKVVVLEFSDPQHNVELCPAWENENGTFIIPNSENGGSWEVVDHRAEIKRIKDSNEQTGKTRALIRMVKKWAELCTAPVKSYVIENKVLEFFSFSNSDSGYSTTIRDFFNYFYSSASDEKLKSHISTALNRATKGCDFESEQKIDKATEEWQKIFGEAFPSAETEKGVVATFHQIISKLQSLFPALTEEHLNRKYGIETVLNPDYSVTVDVNVNQNGWRKNHWLLSEFQKRGYRIQKSASLLFKIISHNVPEPYSVKWKVRNFGNEAQELGALRGEITDDDGSETKKESTLYHGEHYVECYIIRNGQCVAIGHVFVPIG

SEQ ID NO: 5048 - protein, 431 aa, Candidatus Ryanbacteria bacterium
MAIQEQFEKFYENIRLTQAQREDAKRKYDGVCGKLHSYYYPDTKYDGGTRFLIGSYGKRTHIRPARDIDVIFIMPPEKFSQYDDNNSNCQSQLLQDIKTILEEKYPDTPIKAFGKVVVLEFADPQHNVEVQPAWENTDGTFTIPNSENGGSWEIVDPRTEIKRIQTSDEKTGKTKALIRMIKKWSELCTAQVKSYAIENKVLDFFSTNSGGEYAPTIRDFFSYFYNSVSDESLRSHLNTALSRATKACDLENEQKLDKATEEWQKIFGDDFPIAETEKGIVATFHQIVSKLQALFPATTEEHLDRKYGIATVLNPAYSLTVDVNINQNGWRQNHWLLSEFQRRGYRIQKNASLLFKIISHNVPDPYSVKWKVRNFGNDARDLGALRGEITDDDGSETKKESTLYHGEHYVECYIIKNGQCVAVGHVFVPIG

SEQ ID NO: 5049 - protein, 301 aa, Treponema sp.
MEKEFNQFIEKITLTTKQKDEAKTKYTGVCKKVHDYYYDCNYDGSTKFLFGSYKLKTNIRPITKDQDVDVLIKLPQETFEKFNNYQSNGQSALLEEVKSILKEKYTTTDKIKSWGKVILLQFEDSTHNIELLPAFEQDDNSFKIPNTENGGSWEVFNPRAQIDAFNESNKNSDGLTRKICKMVKKWRNFTTSVSIKSCSIQDWAIDFLASNKVDQLEIEEILQKYFEFIRSKCSSDNKSYVETVLKRIEKAINYIDDGEENEASQEFRKIFGNEFPLVEDSSKTNSFDNNIFSTPRPWLEN

SEQ ID NO: 5050 - protein, 307 aa, Labilibaculum manganireducens
MEQEFSKFCENIKLTSQQKEDAKAKYKGVCKKLHDTYYDKDYDDSTKYLFGSYKTKTNVRPLTEEQDVDVLFKIPQETFDKFDEYESNGQSALLQEVRNVLKEKYTTTDKINGWGKVVLVQFEKGKHNVEVLPALEQKDGTFLIPNSEDGGSWDTFDPRNQVNEFQTSNGTTNKLTAELGRMLKTWVKNTPSLKKKYKSYQLINDIITFLKIEFEDGASYEDYHEVVKNFFDWLKRNCVESIKSYVETAYNRAIKAIEFMDANKPKEASEEWIKIFGNEFPKVKENPKNKTENRTIITPSSPWCKLN

SEQ ID NO: 5051 - protein, 307 aa, Labilibaculum manganireducens; identical to SEQ ID NO: 5050

SEQ ID NO: 5052 - protein, 308 aa, Desulforegula conservatrix
MKKQFQEFAENIRLTDQQENDAFTKYDGVCDKLHKYYYATNYDGKTKFLFGSYRTKTNVRPLSDNQDVDVIFKIPEAVFNKFKGYKNNGPSALLQDIRNALKEKYTTTDEIKAWGKVVLVKFTNNRHNVEVLPAYENEDGTFTIPNSENGGSWDKFDPRKQMDAFYDSNQKTNGLTANLARMIKTWVRNTQSLNYKSYNILEDIISFLKKEFKAGADFSEYPVVIKNYLEFINNSCEESIKTHVETALKRSVKAIEYMDSEKPKEASEEWRKIFGYNDKSLFPLVTENPEKRSMARTFLTPSAPYGNL

SEQ ID NO: 5053 - protein, 313 aa, Bacteroides cellulosilyticus
MENSFKNFLSNITLTSDQQEDAQTKYTGVCEKLYKFYYGEGAYDSSKKYLFGSYKTKTNVRPFTEEQDIDVLFKIPEDTFKKYDGYKSNGQCALLQEIKDVLKEKYTTTDKIKAWGKVVLVQFAENHHNVELLPALEKEDGTFLIPNSENGGSWDYFDPRMEIDKFNESNKATSGLTRDLAKMLKAWAHNTPSMSYKSCERMDDIIAFLDANYASGANNIGYDKIVFDFFDYMRSRCNDCIKSYIDKAFNRAQKALEYNDNDKPMEASEEWIKIFGEEFPKTKENSKRENQGVYIQQNPSRPWFGSTKKNRIG

SEQ ID NO: 5054 - protein, 313 aa, Bacteroides sp.
MENSFKDFLSNITLTSGQQEDAQTKYTGVCEKLYKFYYGEGAYDSSKKYLFGSYKTKTNVRPFTEEQDIDVLFKIPEDTFKKYDGYKSNGQCALLQEIKDVLKEKYTTTDKIKAWGKVVLVQFAENHHNVELLPALEKEDGTFLIPNSENGGSWDYFDPRMEIDKFNESNKATSGLTRDLAKMLKAWAHNTPSMSYKSCERMDDIIAFLDANYASGANNIGYDKIVFDFFDYMRSRCNDCIKSYIDKAFNRAQKALEYNDNDKPMEASEEWIKIFGEEFPKTKENSKRENQGVYIQQNPSRPWFGSTKKNRIG

SEQ ID NO: 5055 - protein, 302 aa, Bacteroides paurosaccharolyticus
MEKNFSQFLCNLRLTQNQREDAKKKYEGVINCLARHFYDRGRNDSDQYLFGSYKTKTAIRPIEDGSDVDVLFKIDNDSYEKYKDNASGILQECRNALKDTYSTTEEIHAWGKVVLVKFSDGTHNVEVLPAWEKSDNKFFIPNTEDCGSWETFDPRSQIASFQESIDSTDGLTRDCVMMIKNWVRNTITMKYKSFNVVQDVISFANSIYSSGKRDENYDVVVRDFFNYWVNRLSDKDERRSHFQTALNRANKAVQYEKEGKHIEASEEWRKIFDPKLFPHSDKNEERENEVNRFSTAPRPWSH

SEQ ID NO: 5056 - protein, 423 aa, Sulfurimonas denitrificans
MNNQFKIFNESIRLTTNQENDAKIKYDGVAKTLHNYYYTNAYNGSSKFLFGSYKKKTNIRPFTALQDVDLIFKMPSSEFTKYDNYTSNGQSALLTKIKDILKDTYTTTDTIKGWGKVVLVKFAENTHNIEVLPAWENENGTFTIPNTENGGSWEEFNPRNDLNIFSTSNNLTAGTTSKLTRMIKSWKRNTSSLKIKSFELENYIIDFLSENNDEDLNDSELIRSFFEYLIDNVDENNKSFVQSALNRSNKAIDFESKGRYYKSCEEWRKIFGKKFPKWKDSIRFKSLDEDYSFSEEYIEDLFTQKLDPNYKLKIGCTVTQKGFQQKTPLLELLKKYILIPQKRLEFYIQNNTVPKPYSVYWKVRNFGIEAKNDLRGEITLDDGSETKIENTRYKGEHYVECYIIKDGICVARERVDIPISKEE

SEQ ID NO: 5057 - protein, 430 aa, Candidatus Saccharibacteria bacterium
MDEHFDVLLSRLKLTTKQAEDAKTKYRRVAKTLHNAYYSNEYDGSTKLLIGSYGKRTNIRPPADIDLLFKIPAETYDRYSNYEGNGQAALLQEIRQKLSEKYTTTEKISAWGKVVLVKFSEGSHDVELLPAFEVGGVFMIPNSENSGSWESFDARADMKAISDSDTASGGAARPLIKMIKRWRNHTPSMNLKSYEIEMLVVEFLENNSVAGDSWSEIVSSFFGWLNNKSTSFSSYVSSANNRAIKAREYELNGKLKEACDEWRKIFGNRFPVYDVNLSKIKELTRNYPSSDEEFIENIFDMRPDPNLTLKITVEVAPPKTGGWQQIIRTLEHFIEKFGGLPKASSLQFRAVTNYEGDGRYYWKVRNFGTEAQTSNDLRGKIKEGAPDGTWSENTKYFGTHYIECYLIQGERCVAFNRRYVPINTEVNDEQ

SEQ ID NO: 5058 - protein, 426 aa, Candidatus Saccharibacteria bacterium
MDAYFIEMLGRLKLKKAQRADAKAKYNRIAKALHDEFYTTKYDGKTKLLIGSYGKKTNIRPPQDVDLLFKIPVDTYEQYEQYNGNGASALLQKIRRILDSEYETSETPKAWGKVVLVKFPDGKYDIELLPAYEVGDGVYKIPNTEDGGFFEDFDVGSDLAVVFDSNKETGGVTRRLIKMVKKWKPLHSSLHTKSFEIESFVADYLKSANYDKMSWAERIAGFFEWLQVQPNLHQDDVSLVKNAAERARKAVNYENADKIADACAEWKKVFDNAFPAYNKNKCAVHNLTLRWQVNDEMYIEDNYDVKINPTYNLSINAEVEAKKFRQWPLTDFISKYTYLPKHAKVHFKVKSDVPEPVEYHWKVRNFGAQAASTQNGLRGEIRDRGVRITESTLYQGTHYVEVYVIKDDKCVVKAMRFVPIGDKEDL

SEQ ID NO: 5059 - protein, 449 aa, Candidatus Saccharibacteria bacterium
MIISIVSSGYVISRNNQTPEPMLDWRFYNMDAYFVEMLNRLKLTVKQKEDAVTKYTNVSKLLHNEFYETDYNGSTKLLIGSYGKHTNIRPPEDVDLLFKIPESIYVQYEDSPGALLQRIRNVLNKTYTTTEEIHAWGKVVLIQFSDGTHNVELLPGFEIDGVFMIPNTEDGGAWESFDVRTEMQTIQDSNTLTNGVTRKLIRIIKRWSKYTKTVTIKSYRIEELCVLFLSEYNLNDILWSVLVKDFFGWLSGVDNEDVTDNSTQINTAITRSIKAVEFETDGNTDEACKEWQKIFGKRTFPATSASLVKAFVLNSQQPTDKEMFIEDIVPVRINPLVNIDISAQFVGPKIPVHPFATFIRGRSPVPKRQSIRFNAQITGVDGYDLKWKVRNFGDEAAIAKGLRGEIKNGTGLVLEENTLYEGTHYVECYVISSDVCVARMIHWVPIGRE

SEQ ID NO: 5060 - protein, 446 aa, Acinetobacter sp.
MTTASLFKEFIKNIRIQNSDVISDNYNKVTKALNEYYYESESTSTHCRQIGSYGRKTGINGISDLDMAFELPKGTYDKFNAYSSGGQSALLQDVKKAIQNVYDYDQVKADGQIVGIDLDGFRIEVLPTFYLETNEHGALDYDIYTFPDTNDGGRWRRTKPKLEIEETRNLNNEYGNDTYRHLCRMVRAWKNHAGAKCSGLWIDTLSYNFLKQSEIYKDISYKNYGELVKDFFKYLSDQYDLTPDQKIWKAPGSKQNVHGSWQNHRKMKKAYQLCLEATQDDSVANEKWSKVFGVNFPEEELNQLHESYIVRKKAPNERFIEHAYNGKVDIRNHLSIDYSISQESRTWKMLKKALSNYKVPISRNLEFHIKDTDVEPPYQVKWKVRNIGPAAVTKNQERGALQDSTFGKHKDSHLQEKSSFCGEHWVECYIIKNGVCVARDHVSVHI

SEQ ID NO: 5061 - protein, 446 aa, Acinetobacter schindleri
MTTAALFKKFIENIQIQNINVISENYNKVTKALNEYYYESESTSTHCRQIGSYGRKTGINGISDLDMAFELPKSIYDKFNAYSSGRQSSLLQDVKKAIQNVYDHDQVKADGQIVGIDLDGFRIEVLPTFYLNTNDDGTLDYDIYTFPDSNNGGRWRETKPKLEIEETRRLNDEYGHNTYRHLCRMVRAWKNHVGAKCSGLWIDTLSYNFLKQSENYKNISYKNYGELVKDFFKYLVDQYDLKPDQNIWKAPGSKQNVHGSWQNHRKMKKAYQLCLEALDDESLANEKWSKVFGVNFPEEELEQLHESFIVRKKAPNERFIEHVYDGKVDIRNYLSIDYSISQESRTWKMLKKALSNYKVPISRNLEFHIRDTDVEPPYQVKWKVRNIGPAAVAKNQERGALQDSTFGKHKDSRLQEKSSFCGEHWVECYIIKNGVCVARDHVSVHI

SEQ ID NO: 5062 - protein, 446 aa, Acinetobacter seifertii
MTTASLFKEFIKNIHIQNADIISENYNKVTKALNEYYYESNSDSSHCRQIGSYGRKTGINGISDLDMAFELPKETYDKFNTYSTGGQSALLQDVKKALQKVYDNDQVKADGQIVGIDLDGFRVEVLPTFYLDKDQNGNLNYDIYTFPDTNDGGRWRKTKPKLEIEATRTLNSDYGHDTYRHLCRMVRAWKNHVGTKCSGLWIDTLCYNFLSQSEDYKNISYKSYGELVKDFFKYLFDQYELTPEQKIWKAPGSRQNVHGSWQNHRKIKKAYQLCLEALDDDSLANEKWSKVFGVNFPEEESEQLYESFIVRKKAPNEQFVEFAYNGKIDIRNSLSIDYTISAESRTWKVLKKVLPDYKVPISRKLEFHITSTDVEPPYQVRWKVRNIGPAAVAKNQERGRLQESTYGKHKESRLTEDTNFCGEHWVECYIIKNGICVARDKVSVHI

SEQ ID NO: 5063 - protein, 446 aa, Psychrobacter sp.
MTTASLFNQFIKNIHISNSDEISANYKKVTKALNDYYYESDNDSNNCYQIGSYGRRTGIHGISDLDMAFELPKSTYDKFNSYSSSKQSSLLQDVKKALQEVYEDDRVKADGQIVEVNLDGFRIEVLPTFYLDKDDDGNLDTDIYIYPDTNEGGRWRETKPKKEIRATRELNDECTDNTYRHLSRMIRAWKNNVGINFSGLWIDTLAYNFFNSYSEHKNSSYKDYGDLTKDFFKYLYDQYETSPDKKIWRAPGSNQVVHGSWQGHRKIKKAYQLCLEALEDEVIANENWSKVFGINFPIEENETISESLLAIRKAPDEQFIEYEYSGKVDIRNSVSIDYSISRESKTWKMLKESLPSMTVPMSRDLEFHIQSIDVEPPYEVKWKVRNVGSLAKEKKQQRGKLQPSSSGKHKTSKLVESSNFNGEHWVECYIIKNNICVARDRISVPI

SEQ ID NO: 5064 - protein, 424 aa, Pseudomonas aeruginosa
MSVMSADLFSVFRSNLAVKNADEISVSYKKITKKLNEKYYDSESEFLHCRQVGSYGRRTAVDGVSDLDMAFLLPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5065 - protein, 424 aa, Unknown; identical to SEQ ID NO: 5064
  Description of Unknown: Pseudomonas sequence

SEQ ID NO: 5066 - protein, 424 aa, Pseudomonas aeruginosa
MSVMSADLFSVFRSNLAVKNADEISVSYKKITKKLNEKYYDSESEFLHCRQVGSYGRRTAVDGVSDLDMAFILPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5067 - protein, 424 aa, Pseudomonas aeruginosa
MSVMSADLFSVFRSNLAVKNADEISVSYKKITKKLNEKYYDSESEFLHCRQVGSYGRRTAVDGVSDLDMAFILPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCNNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5068 - protein, 421 aa, Pseudomonas aeruginosa
MSADLFSVFRSNLAVKNADEISVSYKKITKKLNEKYYDSESEFLHCRQVGSYGRRTAVDGVSDLDMAFILPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5069 - protein, 421 aa, Pseudomonas aeruginosa
MSADLFSVFRSNLAVKNADEISVSYKKITKKLNEKYYDSESEFLHCRQVGSYGRRTAVDGVSDLDMAFLLPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5070 - protein, 245 aa, Pseudomonas aeruginosa
MSVMSADLFSVFRSNLAVKNADEISVSYKKITKKLNEKYYDSESEFLHCRQVGSYGRRTAVDGVSDLDMAFLLPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKS

SEQ ID NO: 5071 - protein, 428 aa, Pseudomonas aeruginosa
MSADLFSVFRSNLAVKNADEISVSYKKITKKLNEKYYDSESEFLHCRQVGSYGRRTAVDGVSDLDMAFLLPWDVYHRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARDEFMYLYSNDRGAG

SEQ ID NO: 5072 - protein, 424 aa, Pseudomonas aeruginosa
MSVMSADLFSDFRSNLAVKNADEISVSYKKITKKLNEKYYDSESEFLHCRQVGSYGRRTAVDGVSDLDMAFILPWDVYDRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVEPPYKIYWKVRNTGREAVKRKMQRGNIVIDSGARQITETSNFDGDHFVECYAVKNGVCVARGRVYVPI

SEQ ID NO: 5073 - protein, 424 aa, Pseudomonas aeruginosa
MSVMSADLFSVFRSNLAVKNADEISVSYKKITKKLNEKYYDSESEFLHCRQVGSYGRRTAVDGVSDLDMAFILPWNVYDRFNNYANNKQSALLGEIRKELSDLYPNKTVRAQQQVVSVDFGTYVVEVLPAFENEDGSYTYPDANDGGSWEDCNPIAEIEEVDELHKSTNSNLKRLCKMVRAWKNDHGVAMKGMLIDTLCHNFFKQTDDYDDATYKHYKNLVKDFFAFLVDQDEDQEYWLAPGSKSRVYKTGNFHAKAKKALRRCTEALEDEAVAHERWKTVFGVHFPDVENEEERQQAYKEEFINEKFSLDIKYSLKIDYSVESVGESLRALMSRVIDYRLPKEKKLTFYIVSDNVELPYKIYWKVRNTGREAVKRKMQRGNIVIDSGARQITETSNFDGDHFVECYAVKNGVCVARGRVYVPI

SEQ ID NO: 5074 - protein, 427 aa, Pseudomonas mediterranea
MSKELFEQFRRNLAVKNADEISKSYRQITEKLNGKYYDSTSDILHCRQVGSYGRHTAVHGVSDLDMAFVLPWSEYDRFQRYENNKQSALLGEIRLALKERFPNHEVRAQQQVVSINFTDYVVEVLPAFEHEDGSYTYPDANDGGSWETCNPVAEIDEINALNQAKNHNLKRLCKMVRAWKNDHGVPLKGMMIDTLCYQFLKNTADYDAKSYSAYGEMTRDFFAYLVDIDEVKEQWRAPGSGSIVTKSGNFHPKAKKALRRLQEALDDAEVAHERWSTVFGEHFPEYVEQEKKQAIAENRVKNGEQFIGRKFSLDIQYTLRIDCSVKNEGDRLRNLMSRVITYRIPKQRDLTFWVAEIDVPPPYKIYWKVKNLGPEAIERNMIRGEIRIDSGHHQITEHSTFQGDHYVECYAVKDNVCVARSRIIVPI

SEQ ID NO: 5075 - protein, 427 aa, Pseudomonas mediterranea; identical to SEQ ID NO: 5074

SEQ ID NO: 5076 - protein, 427 aa, Pseudomonas fluorescens
MSKELFEQFRRNLAVKNADEISKSYRQITEKLNGKYYDSTSDILHCRQVGSYGRHTAVHGVSDLDMAFVLPWSEYDRFQRYENNKQSALLGEIRLALKERFPNHEVRAQQQVVSINFTDYVVEVLPAFEHEDGSYTYPDANDGGSWETCNPVAEIDEINTLNQAKNHNLKRLCKMVRAWKNDHGVPLKGMMIDTLCYQFLKSTADYDAKSYSAYGEMTRDFFAYLVDIDEVKEQWRAPGSGSIITKSGNFHPKAKKALRRLQEALDDAEVAHERWSTVFGEHFPEYVEQEKKQAIAENRVKNGEQFIGRKFSLDIQYTLRIDCSVKNEGDRLRNLMSRVITYRIPKQRELTFWVAEIDVPPPYKIYWKVKNLGPEAIERNMIRGEIRIDSGHHQITEHSTFQGDHYVECYAVKDNVCVARSRIIVPI

SEQ ID NO: 5077 - protein, 427 aa, Unknown
  Description of Unknown: Pseudomonas sequence
MSKELFEQFRRNLAVKNADEISKSYRQITEKLNGKYYDSASDILHCRQVGSYGRHTAVHGVSDLDMAFVLPWSVYDRFQRYENNKQSALLGEIRLALKERFPNHEVRAQQQVVSINFTDYVVEVLPAFEHEDDSYTYPDANDGGNWETCNPVAEIDEINALNQAKNHNLKRLCKMVRAWKNDHGVPLKGMMIDTLCYQFLKNTADYDANSYSAYGEMTRDFFAYLVDIDEDKEQWRAPGSGSIVTKSGNFHPKAKKALRRLQEALDDAEVAHERWSTVFGEHFPEYVEQEKKQAIAENRVKNGEQFIGRKFSLDIQYTLRIDCSVKNEGDRLRNLMSRVMTYRIPKQRELTFWVAEIDVPPPYKIYWKVKNLGPEAIERNMIRGEIRIDSGHHQITEHSTFQGDHYVECYAVKDNVCVARSRIIVPI

SEQ ID NO: 5078 - protein, 427 aa, Unknown
  Description of Unknown: Pseudomonas sequence
MSKELFEQFRRNLAVKNADEISKSYRQITEKLNGKYYDSTSETLHCRQVGSYGRHTAVHGVSDLDMAFVLPWSVYDRFQRYENNKQSSLLGEIRLALKERFPNHEVRAQQQVVSINFTDYVVEVLPAFEHEDGSYTYPDANDGGSWKSCSPVAEIDEINELNQAKNHNLKRLCKMVRAWKNDHGVPLKGMMIDTLCYQFFKSTTDYDTKSYSAYGEMTRDFFAYLVDIDEDKEQWRAPGSGSIVTKSGNFHPKAKKALRRLQEALDDAEVAHERWSTVFGEHFPEYVEQEKKQAIAENRVKNGEEFIGRKFSLDVQYTLRIDCSVKNEGDRLRNLMSRVMTYRIPKQRELTFWVAEIDVPPPYKIYWKVKNLGPQAIERNMIRGEIRIDSGHHQITEHSTFQGDHYVECYAVKDNVCVARSRIIVPI

SEQ ID NO: 5079 - protein, 427 aa, Pseudomonas fluorescens
MSKELFEQLRRNLAVKNADEISKSYRQITEKLNGKYYDSTSETLHCRQVGSYGRHTAVHGVSDLDMAFVLPWSVYDRFQRYENNKQSSLLGEIRLALKERFPNHEVRAQQQVVSINFTDYVVEVLPAFEHEDGSYTYPDANDGSSWKSCNPVAEIDEINELNQAKNHNLKRLCKMLRAWKNDHGVPLKGMMIDTLCYQFLKSTTDYDAKSYSAYGEMTRDFFAYLVDIDEDKEQWRAPGSGSIVVKSGSFHPKAKKALRRLQEALDDAGVAHERWSTVFGEHFPEYVEQEKQQALAENRVKNGEEFIGRKFSLDIQYTLRIDCSVKNEGDRLRNLMSRVMTYRIPKQRELTFWVAEIDVPPPYKIYWKVKNLGPQAIERDMIRGEIRIDSGHHQITEHSTFQGDHYVECYAVKDNVCVARSRIIVPI

SEQ ID NO: 5080 - protein, 427 aa, Pseudomonas putida
MSKELFEQFRKNLAVKNADEISKSYRQITEKLNGKYYDSTSETLHCRQVGSYGRHTAVHGVSDLDMAFVLPWSVYDRFQRYDNNKQSSLLGEIRLALKERFPNHEVRAQQQVVSINFSDYVVEVLPAFEHEDGSYTYPDANDGGSWKTCDPVAEIDEINTLNQDKNHNLKRLCKMVRAWKNDHGVPLKGMLIDTLCYQFLKGTTDYDTKSYAAYSEMTRDFFAYLVDIDEDKEQWRAPGSGSIVTKSGNFHPKAKKALRRLQEALDNAEVAHERWSTVFGEHFPEYVEQEKKQAIAENRVKNAEQFIGQKFSLDIQYTLRIDCSVKNEGDRLRNLMSRVMTYRIPKQRELTFWVAEIDVPPPYKIYWKVKNVGPQAIERDMIRGEIRIDSGHRQITEHSTFQGDHYVECYAVKDNVCVARSRIIVPI

SEQ ID NO: 5081 - protein, 427 aa, Pseudomonas sp.
MSKELFEQFRKNLAVKNADEISKSYRQITEKLNGKYYDSTSETLHCRQVGSYGRHTAVHGVSDLDMAFVLPWSVYDRFQRYENNKQSSLFGEIRLALKERFPNHEVRAQQQVVSINFSDYVVEVLPAFEHEDGSYTYPDANDGGSWKTCNPVAEIDEINALNQDKNHNLKRLCKMVRAWKNDHGVPLKGMLIDTLCYQFLKGTMDYDNKSYAAYSQMTRDFFAYLVDINEDKEQWRAPGSGSIATKSGNFHPKAKKALRRLQEALDDGEVAHERWSTVFGEHFPEYVEQDKKQAIAENRVKNAEQFIGQKFSLDIQYTLRIDCSVKNEGDRLRNLMSRVMTYRIPKQRELTFWVAEIDVPPPYKIYWKVKNVGPQAIERNMIRGEIRIDSGYRQITEHSTFQGDHYVECYAVKDNVYVARSRIIVPI

SEQ ID NO: 5082 - protein, 427 aa, Pseudomonas syringae
MSKELFEQFRRNLAVKNADDISKSYRQITEKLNGKYYDSNSETLHCRQVGSYGRHTAVHGVSDLDMAFVLPWSVYDRFQRYENNKQSSLLGEIRLALKERFPNHEVRAQQQVVSINFSDYVVEVLPAFEHEDGSYTYPDANDGGSWETCNPVAEIDEINTLNQDKNHNLKRLCKMVRAWKNDHGVPLEGMLIDTLCYQFLNSTTDYDGKSYAAYSEMTRDFFAYLVDIDEDKEQWRAPGSGSIVTKSGNFHPKSKKALRRLQEALDDAEVAHERWSTVFGEHFPEYIEQEKKRAIVENRVKNGEQFIGQKFSLDIQYTLRIDCSVKNEGDRLRNLMSRVMTYRIPKQRELTFWVAEIDVPPPYKIYWKVKNVGPQAIERNMIRGEIRIDSGHSQITEHSTFQGDHYVECYAVKDNVCVARSRIIVPI

SEQ ID NO: 5083 - protein, 427 aa, Pseudomonas sp.
MSKELFEQFRRNLAVKNADEISKSYRQVTEKLNGKYYDSASETQHCRQVGSYGRHTAVHGVSDLDMAFVLPWSVYDRFQRYENNSQSSLLGEIRLALKERFPNHEVRAQQQVVSINFSDYVVEVLPAFEHEDGSYTYPDANDGGSWETCNPVAEIEEINTLNQDKNHNLKRLCKMVRAWKNDHGVPVKGMLIDTLCYQFLKSTTDYDAKSYAAYSEMTRDFFAYLVDIDEEKEQWRAPGSGSIVNKSGNFHPKAKKALRRLQEALDDAEAAHERWSTVFGEHFPEYVEQEKKQAITENRVKNVEQFIGQKFSLDIQYTLRIDCSVKNEGDRLRNLMSRVMTYRIPKQRELTFWVAEIDVPPPYKIYWKVKNVGPQAIERNMIRGEIRIDSGHSQITEHSTFQGDHYVECYAVKDNVCVARSRIIVPI

SEQ ID NO: 5084 - protein, 427 aa, Unknown
  Description of Unknown: Pseudomonas sequence
MSKELFEQFRRNLAVKNADEISKSYRQITEKLNEKYYDSTSETLHCRQVGSYGRHTAVHGVSDLDMAFVLPWSVYDRFQRYENNKQSSLLGEIRLALKERFPNHEVRAQQQVVSINFSDYVVEVLPAFEHEDGSYTYPDANDGGSWKTCNPVAEIDEINALNQDKNHNLKRLCKMVRAWKNDHGVPLKGMLIDTLCYQFLKETTDYDTKSYAAYSEMTRDFFAYLVDIDEEKEQWRAPGSGSIVTKSGNFHPKAKKALRRLQEALDDAEVAHERWSTVFGEHFPEYVEQEKKQAIAENRVKNAEQFIGQKFSLDIQYTLRIDCSVKNEGDRLRNLMSRVIAYRIPRQRELTFWVSEIDVPPPYKIYWKVKNVGPQAIERDMIRGQIRIDSGYRQITEHSTFQGDHYVECYAVKENVCVARSRIVVPI

SEQ ID NO: 5085 - protein, 427 aa, Pseudomonas sp.
MSKELFEQFRKNLAVRNADEISKSYRQITEKLNGKYYDSDSTTLHCRQVGSYGRHTAVHGISDLDMAFVLPWSVYDRFQKYENNKQSSLLGEIRLALKDRFPNHTVRAQQQVVSVDFTDYIVEVLPVFEHDDGSYTYPDSNDGGSWRTCNPVAEINEINSLNQDKNHNLKRLCKMVRAWKNDHGVPLKGMLIDTLCYQFLKGTTAYDDESYSAYGEMSRDFFAYLVDIDEDKEQWRAPGSGSIVTKSGHFHPKAKKALRRLQEALDDADVAHERWSTVFGEHFPEYVEEEKQQAINEGRVKNMEQFIGQKFSLDIQYNLRIDCSVKNEGDQLRNLMSRVIRYKIPKERELTFWVADIDVPPPYKIYWKVKNVGPQAIERNMIRGEIRMDSGPHQITERSSFQGDHYVECFAVKENVCVARSRIVVPI

SEQ ID NO: 5086 - protein, 427 aa, Unknown
  Description of Unknown: Pseudomonas sequence
MSKDLFEQFRKNLAVKNADEISKSYRKITEKLNEKYYNNVSDTQNCRQVGSYGRHTAVHGVSDLDMVFVLPWSVYDRFQRYESNGQSSLLGEIRAALKERFPHRTVKAQQQVVSVDFSDYVVEVLPAFEQGDGSYTYPDANDGGNWRTCNPVAEIEEINNLNKDKNHNLKRLCKMVRAWKNDHGVPMKGMLIDTLCYQFLKNTSDYDMKSYAAYGEMTRDFFAYLVQVDGDKEQWRAPGSGSIVTKSGNFHPKAKKALSRLQDALDDAAVAHERWSTVFGEHFPEYIEQEKKQAIAENRVKNTEEFISEKFSLDIQYTLRIDCTIKNEEDRLRNLMSRVISYRIPRQRELTFWIAEINVPPPYKIYWKVKNVGPQAIERNMIRGNIRIDSGHNQITEHSNFEGDHYVECYAVKENVCVARGRIVVPI

SEQ ID NO: 5087 - protein, 427 aa, Pseudomonas aeruginosa
MSKDLFEQFRKNLAVKNADEISKSYRKITEKLNEKYYNNVSDTQNCRQVGSYGRHTAVHGVSDLDMVFVLLWSVYDRFQRYESNGQSSLLGEIRAALKERFPHRTVKAQQQVVSVDFSDYVVEVLPAFEQGDGSYTYPDANDGGNWRTCNPVAEIEEINNLNKDKNHNLKRLCKMVRAWKNDHGVPMKGMLIDTLCYQFLKNTSDYDMKSYAAYGEMTRDFFAYLVQVDGDKEQWRAPGSGSIVTKSGNFHPKAKKALSRLQDALDDAAVAHERWSTVFGEHFPEYIEQEKKQAIAENRVKNTEEFISEKFSLDIQYTLRIDCTIKNEEDRLRNLMSRVISYRIPRQRELTFWIAEINVPPPYKIYWKVKNVGPQAIERNMIRGNIRIDSGHNQITEHSNFEGDHYVECYAVKENVCVARGRIVVPI

SEQ ID NO: 5088 - protein, 432 aa, Pseudomonas koreensis
MSATLFNEFRTRLAVKNSDNISTSYKQITKCLNGHYWDSDSDILHCRQVGSYGRHTAIDGVSDLDMLFELPWSVYERFNAYESNGQSSLLGEIKKKLKDRYPTTDITADGQVVVIKYAKYRVELVPVFTNADGTYTYPNTNSGGSWESCDPISEIRAVNKLNDEKNKCLKRLCKMTRAWKNEHGVSMSGYLIDTLCYNFLNSTNDHDKATYSTYKTLVKDFFSYLVSLSTTQESWKAPGSGEAVQKSGNFHSKAKRALLRCTEALDLTDEKKAAKKWKSVFGRKFPLPVTIAMEAIAKDSARSYRDTEQFIDDFYPVDIRYKVEISYDIENQGSAMRALLNRIDLGFKVPKSRKLDFQIIDINVPSPYMIQWKVRNVGGVAEERDMIRGQIINDTGNKKIRETSTFEGEHFVECYVIKDGVCVARDSVEVPI

SEQ ID NO: 5089 - protein, 429 aa, Halomonas salina
MSSKLFSQFRENLAVKNADSISTSYKRITKSLNKKFWDSDSDFTHCRQVGSYGRYTAINGVSDLDMIFELPWSLHDEVQGYSGNKQYKLLSKVCNALKDTYRNSDIKVDGQIVAVKFTKGHVIELVPAFRYTNGSYKYPDTGDGGRWRECDPVAEQIKMKEVNDSKNKNLRVLCKMLRAWKNEHGVPMSGILVDTLGYHFIRSTSDYDSSSYSSYKHMVRDFFGFLVEQDQDKEYWRAPGSGSHVYKKSNFHPKAKKALRRCEEALDDDNPDKKWRAVFGRSFPLESSLTEDVKKSDRSASYTDTEQFIEDLFPVNIKHRLVIDCEINAEGLLKEKLSKVFGFKIPTGKGLNFYVKHIDQIPKSVTYYWKVRNKGKWAVARDQIRGQIRQGNADGKHSESTSFSGDHFVECYAVVEGVCVARDKIKVPI

SEQ ID NO: 5090 - protein, 429 aa, Halomonas sp.
MSSQLFSQFRENLAVKNAESISTSYKRITKSLNKKFWNTDSEFSHCRQVGSYGRYTAINGVSDLDMIFELPWSLYSEVQGYSGNKQYKLLSKVCNALKDTYHNSDIRVDGQIVAVKFTKGHVIELVPAFKNIDGSYKFPDTNDGGKWRECDPVAEQDKMKEINDLKNRNLRTLCKMVRAWKNEHGVPLSGILIDTLGYHFIRSTNDYDNKSYASYKYMVRDFFSYLVDQDQDKEYWRAPGSGSHVYKKANFHPKAKKALRRCEEALEEEKPDKKWRSVFGRKFPLEIKLSEKAMDGNRSLAYANTEEFIDDKFPVNIKYELEIDCEINAEGLLREKLAKLFGYYQIPTGKSLSFYVKYNGVPKPVTYYWKVRNVGVWAESNNQIRGQIKQGNADGKLSERTSFQGDHFVECYAVLDGVCVARDRISVPI

SEQ ID NO: 5091 - protein, 436 aa, Burkholderia cenocepacia
MMSAVLFAQFRKSISVSNEADISTSYRSITTRLNKNFYNSDSDNVHCLQVGSYGRHTAIHGVSDLDMLFELPWNLYERCRQRDGNGPSQLLQAVRDSIKTRYVNTEIKGDGQVVVVQFKKFKVEVLPAFYRKDTKDYIHPDTNNGGSWKVTYPRQEMEAMLEMNERTNRNFKHACKMLRSWKNEHGVPMSGILIDTLCYRFFDECKDFDDKSYAAYPELVAALFTYLANLKQQDYWRAPGSQAHIGNKGNFHRKAKKAAELCIEARDEKNERKRAKLWREVFGREFPLEVTVIATEAFETAHVKRDHGEAGEEFIEDQHPVDIRRKLEIDCDYAGPTTYGHLRALAGHFPWLNHGMSLRFHIVECDVPEPYEVKWKVRNVGEEAVRRNQIRGQIIRDEGRRERKETANFHGPHFVECYVIKNEVCVARDRIEVPIA

SEQ ID NO: 5092 - protein, 435 aa, Burkholderia cenocepacia
MSAVLFAQFRKSISVSNEADISTSYRSITTRLNKNFYNSDSDNVHCLQVGSYGRHTAIHGVSDLDMLFELPWNLYERCRQRDGNGPSQLLQAVRDSIKTRYVNTEIKGDGQVVVVQFKKFKVEVLPAFYRKDTKDYIHPDTNNGGSWKVTYPRQEMEAMLEMNERTNRNFKHACKMLRSWKNEHGVPMSGILIDTLCYRFFDECKDFDDKSYAAYPELVAALFTYLANLKQQDYWRAPGSQAHIGNKGNFHRKAKKAAELCIEARDEKNERKRAKLWREVFGREFPLEVTVIATEAFETAHVKRDHGEAGEEFIEDQHPVDIRRKLEIDCDYAGPTTYGHLRALAGHFPWLNHGMSLRFHIVECDVPEPYEVKWKVRNVGEEAVRRNQIRGQIIRDEGRRERKETANFHGPHFVECYVIKNEVCVARDRIEVPIA

SEQ ID NO: 5093 - protein, 435 aa, Burkholderia territorii
MSAVLFAQFRKNISVSNAADISTSYRSITTRLNKDFYNSDSDNVHCLQVGSYGRHTAIHGVSDLDMLFELPWNLYERYRQRDGNGPSQLLQAVRDSIKTRYVNTEIKGDGQVVVVQFKKFKVEVLPAFYRKDTNDYIHPDTNNGGSWKVTYPRQEMEAMLEMNERTNRNFRHACKMLRSWKNEHGVPMSGILIDTHCYRFFDECKDFDDKSYAAYPELVAALFTYLANLQQQDYWRAPGSQAHIANKGNFHRKAKKAAELCIEARDEKNERKRAKLWREVFGREFPLEVTVIATEAFETPHVKRDHGEAGEEFIEDQHPVDIRRKLEIDCDYAGPTTYGHLRALAGHFPWLKHGMSLRFHIVECDVPEPYEVKWKVRNVGEEAVRRNQIRGQIIRDEGRRERKETANFHGPHFVECYVIKNEVCVARDRIEVPIA

SEQ ID NO: 5094 - protein, 435 aa, Burkholderia stagnalis
MSSALFEQFRKNISVGNASDISTSYQSITTRLNKDFYQSDSNNVHCLQVGSYGRHTAIHGISDLDMLFELPWALYERYRERENNGPSQLLQAARDSLKARYPSTEIKGDGQVVVVQFQKFKVEVLPAFYRKDTNDYLHPDTNNGGSWKVTYPQQEMDAMRKMNERTNRNFRHACKMLRSWKNEHGAPMSGILIDTLCYRFFEGCKDFDEKSYGAYPELVAALFTYLEGLEQKDYWRAPGSQAHIASKGNFHRKAKKAAQTCIQARDEKDEKKRAKLWREVFGRDFPVGVQVVKAAATESLSFKRDYGDAAEEFIEDKYPVDIRRKLEIDCDYAGTTNSGRLRALAQVFPWLKHGMSLRFHIAECDVQEPYEVMWKVRNVGDEAVRRNQIRGQIVRDEGRRERKETANFHGPHFVECFVIKNGVCVARDRIDVPIE

SEQ ID NO: 5095 - protein, 435 aa, Burkholderia sp.
MSSALFEQFRKNISVGNASDISTSYQSITTRLNKDFYQSDSNNVHCLQVGSYGRHTAIHGISDLDMLFELPWAVYERYRERENNGPSQLLQAVRDSLKARYPSTEIKGDGQVVVVQFQKFKVEVLPAFYRKDTNDYLHPDTNNGGSWKVTYPQQEMDAMRKMNERTNRNFRHACKMLRSWKNEHGAPMSGILIDTLCYRFFEGCKEFDEKSYGAYPELVAALFTYLEGLEQKDYWRAPGSQAHIASKGNFHRKAKKAAQTCIQARDEKDEKKRAKLWREVFGRDFPVGVQVVKAAATESLSFKRDYGDAAEEFIEDKYPVDIRRKLEIDCDYAGTTNSGCLRALAQVFPWLKHGMSLRFHIAECDVQEPYEVMWKVRNVGDEAVRRNQIRGQIVRDEGRRERRETANFHGPHFVECFVIKNGVCVARDRIDVPIE

SEQ ID NO: 5096 - protein, 436 aa, Paraburkholderia ribeironis
MSSALFEQFRKNISIGNASEISTSYQSITTRLNKDFYESDSDNAHCLQVGSYGRHTAIHGISDLDMLFELPWELYERYRQREGNGPSQLLQAVRDSLKTRYSSTEIKGDGQVVVVQFKKFKVEVLPAFYRKDTNDYLHPDTNNGGSWKVTYPRQEMDAMREMNTRTNRNFRHACKMLRSWKNEHGVPMSGILIDTLCYRFFEGCKDFDQKSYAAYPELVATLFTYLADLEQKDYWRAPGSQAHIANKGNFHRKAKKAAQACIQARDETDEPKRAKLWREVFGRDFPLEVKVVRTTAATESFSFKRDSGDAAEEFIEDKYPVDIRSELEVDCDYASTTQNGRLRALANTFPWLKHGMSLRFHIVECDVGEPYEVMWKVRNVGDEAVRRNQIRGQIVRDGGSRERKETANFHGPHFVECYVIRNGVCVARDRIDVPIE

SEQ ID NO: 5097 - protein, 438 aa, Methylotenera mobilis
MSAPLFKLFRDNIAVQNAADISTSYTEITKRLNLDFWNIESDIAHCRQVGSYGRNTAVHGISDLDMVFELPWSTYEKYKAYTNNGPSQLLQAVRNSLLTRYPNTTIKGDGQVVCIEFGKFRVEVLPAFWDKDADGYRFGDTHDGGTWKVCKPIQEINAVNQRNKETNRNLKHVCKMIRAWKNSNGVNISGMLIDTLVYNFFGQTNEYDTASYSSYDRLLVSLFSYIGNLEHQDFWLAPGSGQRVNNKGKFQSKAKKAAVKCQEALDADTEKKKIKIWRDVFGRSFPGEVLKLEKAAAVYESVNYRSTTEQFIEDQYPVDIQFDLEINSEVSTNGQHTGLLRALLKQWLPVGQGLRFFVESCDVPTPYTLLWKVRNVGAEAERRRMIRGDIFLDEGKSQRIEKTTFHGEHFVEAYVIKEGVCVARDLIDVPISENIQVS

SEQ ID NO: 5098 - protein, 433 aa, Herbaspirillum sp.
MSTSLFQQFRGNLVVQNAGEISTSYASITKRLNKDFWEVDSDVSHRRQVGSYGRGTAINGVSDLDMVFELPWAMYDRYKAYSSNGPSQLLQAVKNSLKNRYPSTDIKGDGQVVVVEFSKFVVEVLPAFWDANSQCYHFGDTHGEGTWKTCKPIQEIAAVDDRNIKTNRNLKHACKMIRAWKNTHGINMSGILIDTLVYNFFGQTDEFNLVSYGSYDRMFVSLFSYLGNLDHQDYWAAPGSGQRVYSKGKFQSKAKKAAVKCQEALESDKEKKKIKLWREVFGRTFPAVDATRIAVEAHAQDSAAYTTEQFIEDLYPVDVRYDLSIDSDVIDNGVKGERLRRLSAVFQWLPIGRSLRFFVEENTVPKPYQLLWKVRNVGTEAERRGIRGQIFPDEGRMERRERTDFHGDHFVEAYIIKDEVCVARDVIDVRINQ

SEQ ID NO: 5099 - protein, 435 aa, Noviherbaspirillum humi
MSAAFFQQFRENLSVQNASDISTSYASITTRLNKDFWNQESDVYHRRQVGSYGRKTAIHGISDLDMVFELPWPLYERYKAYEGNGPSQLLQAVRKSLQARYRKTEIKGDGQVVVIEFSKFVVEVLPAFVDKECDGYRFGDANNGGSWKLCKPVQEMDAVDQRNIATNRNLKHVCKMLRAWKNTHGVNMGGLLIDTLAYNFFGQNSEYNDKSYAAYDKLFVALFTYLGGLDHQDYWAAPGSGQRVHSKGKFQSKAKKAAAKCQEALETDKEKKKVKLWREVFGRSFPTEIVTSAKSESVAQHDTSRYTTEQFIEDMYPVDIRFDLTIDSDVLHEGANAGRLRMLAQRFFWLPQGRSLRFHVVECDVPRPYQLMWKIRNVGTEAERRDCIRGQIFFDHGKQEQRERTDFHGEHFVEAYVIKDGVCVARDVIDVRINQ

SEQ ID NO: 5100 - protein, 434 aa, Thauera sp.
MSANLFEQFRTNLQVANSDAISNSYRAITKRLNKDFWDIDSEEQHCLQVGSYGRHTAIRDVSDLDMVFELPQSVYERVSKVNANGPSQLLQEVRKSLKERYPASDIRAAQQVVQVHFEKYRIEVLPAFKQADGRYRYGDANDGGSWDNYCNPRAEINALNTQNKTSNRNLKRVCKMLRAWKNKHGAPMSGMLIDTLVSRFFQENTSYNDKSYSSYPALTRDVFAFLGNLDEQDYWLAPGSRSRVQTKGKFQRKAKKAAAKCQDALDAGKDTKKVKLWKEVFGRRFPSLQTDSATKAFVEARQDTKTEQFIEDLYPVDIQYSLDIECIVAYAGNEETRYRFMESVFPWLKLGRSLTFIIVNCNVPEPYEIFWKVRNVGVVAERRNMIRGHITRDTGRRQAVETTSFGGEHFVECYVIKDGICVARDLIEVPIEIT

SEQ ID NO: 5101 - protein, 434 aa, Cupriavidus taiwanensis
MSSTLFEQFRKNLAVANQEDISTSYAEITKRLNKDYWDSSSETANSLQVGSYGRQTAIRNVSDLDMIFELPQKVFDRVSEVQNNGPSQLLQEIRQSIKARYPNTKVNGDGQVVVVSFGKYVVEVLPAFLQMDGSYRYGDSNNGGSWNNYCLPRKEISAVNEVNKRCNRNLKRVAKMVRAWKNVHGAAMSGMLIDTLVYNFFRDNTDYDQKSYGSYPELVRDIFSFLANRPEQQYWLAPGSNSRVATKGKFQRKAKKAAAKAQEALDADNEKTKQRLWREIFGPLFPSVQTGTLSKAFESYAEASNTEQYIEDENPVDIQYELEIGYDVAYAGKHEARIKFMEKTFPWLKLGRNLEFFVVDCNVPEPYEMLWKVRNVGLLAEKKNQIRGELMRDAGRRRLTERTSFGGHHFVECYVLKDNVCVARDRIEVPIELS

SEQ ID NO: 5102 - protein, 430 aa, Gammaproteobacteria bacterium
MSQASLFKEFRANLTVANAEAISISYNNITARLNKDYWDSESDVYHSMKIGSWGRHTAINGVSDLDMVFEIPEDDYNRYKNLQGNGPSTMLREVKECLQARYPTTLIKADGQIVGVFFKDYRVEVLPAFRDADDNYVHGDTNNGGTWKTTKPRPEIAAVNALDKLANGNLKQVCKMLRAWKNQNGVGIGGLLVDTFAYNFFVENDEYHSAAFSNYPDLMVSVFAYLGGLPFQDYWYAPGSNQRVKCKTKFQAKARKAAAKSELASKAEDEVEQSKLWRQIFGPLFPKVEAVAKSAVLAESIVDHEEFIEDTAPLDIRYDIEIDCEVKQANVLTDLLRTMRKSGKRLPTGRHLRFFVRSSDVPPPYLLKWKVRNRGAEARRRNMLRGEISPDGGQSQRLESTSFAGDHYVEVYAIKDGYTVARDRISVPIE

SEQ ID NO: 5103 - protein, 427 aa, Frateuria sp.
MSIASLFKDFRLALSVSNAADISQKYCSITTRLNADFWGIDSDQRNSLQIGSYGRHTAIDGVSDLDMAFELPAAELERYKKLEGNGPSSMLREVRESLKKRYPNTTIKADGQIVGVFFDRYHIEVLPAFLNADGNYIHGDTNNGGSWKVTKPRPEIKAVNDLNKVTNGNLKDVSKMLRAWKNKAGVGIGGLLIDTFAYNFFSQSNKFNEATYSTYPDLFLGLFTYLGALPEQEYWIAPGSGQRVRCKSKFQAKAKKAAKRCQEAIDAVGDAAQAKLWRKIFGRHFPKVTAMAEAAAADDRDGEQFIEDLYPVDIRYDIELDCETKEANVLRDALQKMLRSRQRVPVGRHLRFHVVNCDVPGNYSLFWKVRNRGAEAIRRDQLRGEITPDQGKRERTETASFPGEHYVEVYAVQDGVVVARDRIGVPI

SEQ ID NO: 5104 - protein, 430 aa, Stenotrophomonas maltophilia
MSDASLFSQFRQNLSVSNADEISTKYANITTRLNLDFWEIESDTRHSLQVGSYGRKTAIDGVSDLDMVFELPIEDYERYKKLEGNGPSTMLQEVRNSLLKRYPKSDVRADGQIVAVNFAGYRVEVLPAFLDENGDYIYGDTNDGGTWKLTKPRPEIKAVNDLNNATNQNLKDACKMLRAWKNKVGVGIGGLLIDTLTYNFFNQTDDYDNAGWADFPAMFVSLFTYLGGLDPDQEYWAAPGSGQRVKRKAKFQSKAKKAAARCQEAIDTEGEAARAKIWRKVFGKQFPKAETVAKSARYSFDKEEFIEDRYPVDVRYNIELDCEIREGTSFQDLLRRKLRNRERVPTGRHLRFTVTACNVPGNYQLFWKVRNRGQEAINREMLRGEITPDKGNGREKIETSDFAGRHYVEIYAVKDGVCVARERIAVPIEA

SEQ ID NO: 5105 - protein, 440 aa, Bifidobacterium longum
MNETATFDAFFESIKLDSLNEYQNVLDCIGKKLNDSFYHIDSKNEHLIIVGSIGRGTAVPGTSDLDVLFDLPEDVFHTFDSYKSNGQSALLQKVKEAVKERYPKTDVRGDGQAVVISFESKNFTVDLVPAFRQTDGSFKYPDSHNGGSWKTTNPIPEQEACTTLFAQTDNAALHICNALRIWKNNVGFHFKGLLIDTLVGKYFDQKNSIPLNSYDLFIDVFENLSLVNRNQSYWHAIGSNQQVTNDDKGAFVPKSQKALNILRAASSESDREEALIKLFGKTIAKCMVDSIHQENERKFLKKYSITNNEEFIEDLFTIDISNYLEIDCKVTQDGWRTKSLRDMLSKHLPLLPRKQLDFHIVRCDVKSPYEIYWKVRNCGEEAFKRNCIRGQITEGTLDAPLREHADFQGPHFVECYAVKNGICVARSRIDVPISETGEII

SEQ ID NO: 5106 - protein, 392 aa, Bifidobacterium lemurum
MIVVGSVGRGTAVAQTSDIDVLYDLPSDIKKQYSDHQHGQTDLLQDIRNTLLERFPQTTIKGDGQAVVIDFSSKRFTIDLVPAFANTDGSFDYPDTHDGGSWKRTDPFPEQKACARMEEESFGWFVRLCNSTRAWADAQGISFSGLLIDTLVNNYLNGHMPKSAAFDETYTMLQELFSYFGRQNQQQSFWHALGSNQQIRDKGKGKFIRKASKAADKLEQAESEEEREDALSDLFGKLFTSSIVDGESKRHQSNWLRDYRCSDQEEFIEDRFPIRISMDVYIDCKITQNGFRPFFLSGLLRERMPLRRDKQLRFFIQKPTEMDQSCVVYWKIRNRGEEAYRRNMLRGQIIKDEGKHERIEHSNFNGNHFVECYVVRDGICIGRDRIIVPISE

SEQ ID NO: 5107 - protein, 373 aa, Streptococcus pneumoniae
MSLSNDFKEFCEDELYMTDEEWEKWENRLKEITKRLNRKYYSLDELDNQETDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKSKSLNSNFNNHFSNLTRLIRQWKNHMGFSFKGLLIDTLISDLIDDKGISEIYYSDYNILLKDIFEYFSNQDKNREYWYALGSNQKIYNNDGAKFINKAKQALKKIEDASEEKLTEVYRQLFGRKFAQSTSTTNRASNEEFIDELFSIDIRYNIVLECEITQDGFRKALLSDFLKSRFKIKNENLLILKLYNQIFQIIFCLMLNIIGK

SEQ ID NO: 5108 - protein, 338 aa, Streptococcus mitis
MSLSNDFKEFCEDELPMTDEEWEKWKNRLKEITKRLNRKYYSLDELEDEEIDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKSKSLNSNFNNHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEITQDGFRKALLSDF

SEQ ID NO: 5109 - protein, 440 aa, Streptococcus pneumoniae
MSLSNDFKEFCEDELYMTDEEWEKWENRLKEITKRLNRKYYSLDELDNQETDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKSKSLNSNFNNHFSNLTRLIRQWKNHMGFSFKGLLIDTLISDLIDDKGISEIYYSDYNILLKDIFEYFSNQDKNREYWYALGSNQKIYNNDGAKFINKAKQALKKIEDASEEKLTEVYRQLFGRKFAQSTSTTNRASNEEFIDELFSIDIRYNIVLECEITQDGFRKALLSDFLKSRFKIKNRKSLDFEIIQSDIPDNLLSDVKYYWKVRNIGAEAIRRNCERGAIFSGKIKHHEDSQFKGDHYVECYAVLDNTVIARDRITVPIDPLRGKDFIE

SEQ ID NO: 5110 - protein, 440 aa, Streptococcus mitis
MSLSNDFKEFCEDELPMTDEEWEKWKNRLKEITKRLNRKYYSLYDLADEEIDNGLIVGSVGRTTAVRNVSDFDYIFSLPSEVYRRFDSYEGNGQSALLQEIKNELLKRYPDTNIKGDGQVVVIDFRDDGKIELVPAFEQSDGNFKYPDSRNGGSWKTTKPKPEIEKSKSLNSNFNNHFSNLTRFIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEITQDGFRKALLSDFLKSRFKIKNRKSLDFEIIKSDIPDDLLSDVKYYWKVRNIGAEAIRRNCERGAIFSGKIKHHEDSQFKGDHYVECYAVLDNTVIARDRITVPIDPLRGRDFIE

SEQ ID NO: 5111 - protein, 440 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKSEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIECNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5112 - protein, 440 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKSEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDVSEEKLTEVYRQLFGRKFAQSTSTTNRASNEEFIDELFNVNIEYNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5113 - protein, 326 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKFEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEIT

SEQ ID NO: 5114 - protein, 326 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKFEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVSLLYTY

SEQ ID NO: 5115 - protein, 438 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKSEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLLGRKFAQSTSTTNRASNEEFIDELFNVNIEYNIVLECEITQDGFRKALLSDFLKSRFKIKNRKSLDFEIIKSDIPDNLLSDVKYYWKVRNIGAEAIRSERGAIFSGKIKHHEDSQFKGDHYVECYAVLDNTVIARDRITVPIDPLCGKDFIE

SEQ ID NO: 5116 - protein, 440 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKSEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5117 - protein, 440 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKFEIEKCKSLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5118 - protein, 440 aa, Streptococcus pneumoniae
MSLSNDFKEFCEDELPMTDEEWEKWENRLKEITKRLNRKFYSLDELDDQETDNGLIVGSVGRTTAVRNVSDFDYIFSLPSEVYRRFDSYEGNGQSALLQEIKNELLKRYPNTKIKGDGQVVVIDFSDGGKIELVPAFEKSDGNFKYPDSRNGGSWKTTKPKSEIEKCKFLNSNFNSHFSNLTRLIRQWKNHMGFSFKGLLIDTLISDLIDDKGISEIYYSDYNILLKDIFEYFSNQDKNREYWYALGSNQKIYNNDGAKFVNKAKQALKKIEDASEEKLTEVYRQLFGRKFAQSTSTTNRASNEEFIDELFNVNIEYNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5119 - protein, 440 aa, Unknown
  Description of Unknown: Streptococcus sequence
MSLSNDFKEFCEDELPMTDEEWEKWENRLKEITKRLNRKYYSLDELEDEETDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKCKSLNSNFNNHFSNLTRLIRRWKNHMGFSFKGLLIDTLISDFIDDKGISEIYYSDYNILLKDIFEYFSNQDKNREYWYALGSNQKIYNNDGAKFINKAKQALKKIEDASEEKLTEVYRQLFGRKFAQSTSTTNRASNEEFIDELFSVDIRYNIVLECEITQDGFRKALLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLCGKDFIE

SEQ ID NO: 5120 - protein, 440 aa, Streptococcus mitis
MSLSNDFKEFCEDELPMTDEEWEKWKNRLKEITKRLNRKYYSLDELEDEEIDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKCKSLNSNFNNHFSNLTRLIRRWKNHMGFSFKGLLIDALISDFIDDKGISEIYYSDYNILLKDIFEYFSSQDKNREYWYALGSNQKIYNSDGAKFINKAKQALKKIEDASEEKLTEVYRQLFGRKFAQSTSTTNRASNEEFIDELFSIDIRYNIVLECEITQDGFRKALLSDFLKNRFKIKNRKSLDFEIIQSDIPDNLLSDVKYYWKVRNIGAEAIRRNCERGAIFSGKIKHHEDSQFKGDHYVECYAVLDNTVIARDRITVPIDPLRGKDFIE

SEQ ID NO: 5121 - protein, 440 aa, Streptococcus gordonii
MTLSNDFKDFCEDELPITDEEWEKWENRLKGITKRLNRKYYLPDELDDEETDNGLIVGSVGRTTAVRNVSDFDYIFSLPSEVYRRFDSYEGNGQSALLQEIKNELLKRYPNTKIKGDGQVVVIDFSDGGKIELVPAFEQSDGNFKYPDSRNGGSWKTTKPKPEIEKCKSLNSNFNNHFSNLTRLIRRWKNHIGFSLKGLLIDTLVSDFIDDKGISEIDYSDYNILLKDIFEYFSNQDKNRDCWYALGSNQKIYNTDGAKFINKAKKALKKIEDASEEELTEVYRHLFGRKFAQSSSTTNRASNEEFIDELFSVDIRYNIVLECEITQDGFRKAFLSDFLKSRFKIKNRKSLDFEIIKSDIPDNLLSDVKYYWKVRNIGAEAIRRNCERGAIFSGKIKHHEDSQFKGDHYVECYAVLDNTVIARDRITVPIDPLSGKDYAF

SEQ ID NO: 5122 - protein, 406 aa, Lactococcus fujiensis
MVRDEDEVEKWQDRIDKINNKLCDKYYDLRDNQMLQVGSIGRGTAITKTSDYDVIFKLPREVYSRFDSHENNGQSKLLQEVKEEIRKLYSSTNIKGDGQVVVISFTDGRIELVPGFEQTDGSFKFPDSHGDGSWKTTKPIPEIEKSREMKNQTNGIFNYLCYLMRQWKNHIGFSFKGLLIDTMVCDYLDENDDFRDKSEFDLLKDLFEFLTKQDKERVCWLALGSNQKITNDDGGKFITKAKKALKKFDDEDEEKVLHELFGYKKKETKAASEQFIEDLGYKVDIRYNLKLDCDVSQPGMLTRKLSDFLSSHWKILGGRRLRFYVANARQFYDLGLNVEYYWKVRNVGAEAKRRNCERGQIKRGDKTHEEPTSFNGNHYVECYAVVDDVVVARGRIDVPIDVVKGM

SEQ ID NO: 5123 - protein, 414 aa, Lactococcus fujiensis
MIIDFAKTLVRDEDEVEKWQDRIDKINNKLCDKYYDLRDNQMLQVGSIGRGTAITKTSDYDVIFKLPREVYSRFDSHENNGQSKLLQEVKEEIRKLYSSTNIKGDGQVVVISFTDGRIELVPGFEQTDGSFKFPDSHGDGSWKTTKPIPEIEKSREMKNQTNGIFNYLCYLMRQWKNHIGFSFKGLLIDTMVCDYLDENDDFRDKSEFDLLKDLFEFLTKQDKERVCWLALGSNQKITNDDGGKFITKAKKALKKFDDEDEEKVLHELFGYKKKETKAASEQFIEDLGYKVDIRYNLKLDCDVSQPGMLTRKLSDFLSSHWKILGGRRLRFYVANARQFYDLGLNVEYYWKVRNVGAEAKRRNCERGQIKRGDKTHEEPTSFNGNHYVECYAVVDDVVVARGRIDVPIDVVKGM

SEQ ID NO: 5124 - protein, 237 aa, Pilibacter termitis
MGLSKEFKDYCSDIQITSEEAEKWITRLEAITKRLNKKYYDSTSNRDHMIVVGSVGRDTAIHGVSDWDCIFSLPQDIYKKFDDYETNGQSALLQEIKRELQGLYSRTDIKGDGQVVVVSFGDGVVELVPGFEESDRNYKYPDSNGGGSWKITKPIPEQEAGKEISDETNYHYVYFCQLLRKWKNNIGFKFKGLLIDTLVKKFIDADDSRKTVAFSDYGTLCLNSFQKKMRIGATGMR

SEQ ID NO: 5125 - protein, 440 aa, Listeria monocytogenes
MTLSNHFEDFCEEITVGNDETEKWTERIKRITQKLNKKYYDSSSGEDNILIVGSVGRGTAMHNVSDYDCIFELPSEKFKQFDNYSGNGQSALLQEVKKEIKLSYPTTKVKGDGQVVVVSFIDGDIELVPAFRQSDDNFKYPDSNNGGSWKKTKPLPEINEAERLTKLIETHYINFCRLMRHWKNEIGFKFKGLLIDTMVKNFFEEDDDRKNLKYSNYYDSLIDFFKFLSEQNADCAYWYALGSNQQITNNDKGKFIKMAKKAYNLLKDISANSDDVITKLRELLGKEFAKTVVENKASLSTRLAPNEELPESKFIVDVRYNLKLDYTVEQEGFRPKKMSYFTNNKYKLKAKKNLNFYIESIDIPDYLLPSVEWYWKVRNIGPEAIRKNCERGQIRKGSIKHQESTAFNGEHYVECYAVIGRRMIAKGRAKVPIDITYGID

SEQ ID NO: 5126 - protein, 440 aa, Listeria monocytogenes
MTLSNHFEDFCEEITVGNDETEKWTERIKRITQKLNKKYYDSSSGEDNILIVGSVGRGTAMHNVSDYDCIFELPSEKFKQFDNYSGNGQSALLQEVKKEIKLSYPTTKVKGDGQVVVVSFIDGDIELVPAFRQSDDNFKYPDSNNGGSWKKTKPLPEINEAERLTKLIETHYINFCRLMRHWKNEIGFKFKGLLIDTMVKNFFEEDDDRKNLKYSNYYDSLIDFFKFLSEQNADCAYWYALGSNQQITNNDKGKFIKMAKKAYNLLKDISANSDDVITKLRELLGKEFAKTVVENKASLSTRLAPNEELPESKFIVDVQYNLKLDYTVEQEGFRPKKMSYFTNNKYKLKAKKNLNFYIESIDIPDYLLPSVEWYWKVRNIGPEAIRKNCERGQIRKGSIKHQESTAFNGEHYVECYAVIGRRMIAKGRAKVPIDITYGID

SEQ ID NO: 5127 - protein, 443 aa, Streptococcus suis
MSLADYFEKFCEEELPITDDEFQKWDSRLKEITKKLNLKYYPDDDFKDVEKDHLYIVGSVGRKTAIKNTSDFDILFQLPQEVYNQYNNYSGNGQSALLQEMKNIIKERYSTTDIRGDGQVVVIEFKSNPAGVIELVPAFEQIDGSFKYPDSHNGGSWKTTNPTPEINECNNLSGKTDGHFINLCRLLRKWKNTEGFAFKGLLIDTLVSNYFESRGSYSMSYRDYERDVVDLFGYLAEQDKNRKYWYALGSNQQISNNDNGRFIAKAKKAYKALFETEDIVEEFKKLFGSSFAKTTASFISNRAAPGEQFIEDMFPINIRFNLELDCKITQDGWRPQLLRDFLKNKIKLKDKKSLDFYIAKSEIPTYLEPNVEYYWKVRNVGSEAVRRNCERGQIYKGTNRKRETADFRGSHFVECYAVHSGVVIAKAKIDVPIDPIAGKDLVF

SEQ ID NO: 5128 - protein, 440 aa, Streptococcus suis
MSLAEHFKDFCEEELPIEESEFDKWCGRLKKITKKLNKKYYPEDNFEDIESENCYIVGSVGRGTAIAKTSDFDCIFKLPQEVYDKFNNHSGNGQSKLLQEVKNEIALSYPSTRIKGDGQVVSITFTSSPAGTIELVPAFEQDNGDFKHPDTHDGGSWKLTKPTPEISECNRLKDETEGHFINFCRLLRKWKNKNGFVFKGLLIDTMVSKYLEDENINLIRYTDYEELIPELFKFLSEQDKERSYWFALGSNQQIENSDNGKFITKAKKTYNLLKDSTSLIKDYRAIFGNQFAKSDSSASNMIAPEEQFIEDMFPIHIRYNLELDCDVTQKGFRKYTLRNILSRGFKLKDKKSLDFYILNTNIPSTLSGVEFFWKVRNVGVEAIKRGRERGQIIKGGTKKHENTEFKGMHYVECYAIHEGVVIARGRIEVPIDPYSKIHSI

SEQ ID NO: 5129 - protein, 440 aa, Streptococcus suis
MSLAEHFKDFCEEELPIEESEFDKWCGRLKKITKKLNKKYYPEDDFEDIESENCYIVGSVGRGTAIAKTSDFDCIFKLPQEVYDKFNNHSGNGQSKLLQEVKNEIALSYPSTKIKGDGQVVSITFTSSPAGTIELVPAFEQDNGEFKHPDTHDGGSWKLTKPTPEISECNRLKDETEGHFINFCRLLRKWKNKNGFVFKGLLIDTMVSKYLEDENINLIRYSDYEELIPELFKFLSEQDKERSYWFALGSNQQIENSDNGKFITKAKKTYNLLKDSTSLIKDYREIFGNQFAKSDSSASNMIAPEEQFIEDMFPIHIRYNLELDCDVTQKGFRKYTLRNILSRGFKLKDKKSLDFYILNTSIPSALSGVEFFWKVRNVGVEAIKRGRERGQIIKGGTKKHENTEFKGMHYVECYAIHEGVVIARGRIEVPIDPYSKIHSI

SEQ ID NO: 5130 - protein, 440 aa, Streptococcus suis
MSLAEHFKDFCEEELPIEESEFDKWCGRLKKITKKLNKKYYPEDDFEDIESENCYIVGSVGRGTAIAKTSDFDCIFKLPQEVYDKFNNHSGNGQSKLLQEVKNEIALSYPSTKIKGDGQVVSITFTSSPAGTIELVPAFEQDNGDFKHPDTHDGGSWKLTKPTPEISECNRLKDETEGHFINFCRLLRKWKNKNGFVFKGLLIDTMVSKYLEDENINLIRYSDYEELIPELFKFLSEQDKERSYWFALGSNQQIENSDNGKFITKAKKTYNLLKDSTSLIKDYRAIFGNQFAKSDSFVSNMIAPEEQFIEDMFPIHIRYNLELDCDVTQKGFRKYTLRNILSRGFKLKDKKSLDFYILNTNIPSTLSGVEFFWKVRNVGVEAIKRGRERGQIIKGGTKKHENTEFKGMHYVECYAIHEGVVIARGRIEVPIDPYSKIHSI

SEQ ID NO: 5131 - protein, 440 aa, Streptococcus suis
MSLAEHFKDFCEDELPISELEFSRWHNRLKEITKKLNKKYYPDNDFEDIETDNCYIVGSVGRGTAIAKTSDFDCIFKLPQEVYDRFNNHSGNGQSKLLQEVKDEIALRYPSTKIKGDGQVVSVTFTSNPAGTIELVPAFEQDNGDFKFPNTHDGGSWKTTKPTPEISECSRISADTDGHFINFCRLLRKWKNKNGFVFKGLLIDTMVADYLEDEGIGSINYSDYEELIPDLFKFLSEQDKERSYWLALGSNQQIENSDNGKFIAKAKKTYNLLKDSTNLIKDYRNTFGSQFAKSDSSVSNMIAPEEQFIEDMFPIHIQYNLELDCDITQNGFRKYTLRDILSRGFKLKDKKSLDFYILKTNIPNTLRGVEYFWKVRNVGTEAVRRGCERGQIIKGATKKHENTEFKGMHYVECYAVFEGVVIARGRIEVPIDPYSGLISI

SEQ ID NO: 5132 - protein, 438 aa, Streptococcus henryi
MSLAEHFKDFCEDELPISESEFNQWHNRLKEITKKLNKKYYPDDNFEDIETDNCYIVGSVGRGTAIAKTSDFDCIFKLPQEVYDRFNNHSGNGQSKLLQEVKDEISSRYPSTKIKGDGQVVSITFTSSPAGTIELVPAFEQDNGDFKYPNTHDGGSWKITKPTPEISECNRLSDETNGHFINFCRLLRKWKNKNGFVFKGLLIDTMVSNYLEDGDINSISYSNYEELIPNLFKFLSEQDKDRSYWLALGSNQQIENSDSGKFINKAKKTYNLLKESTNLVKDYRTTFGNQFAKSDSSVSNMIAPEEQFIEDMFPIHIRYNLEIDCDVTQNGFRKRTLRDILSKGFKLKDKKSLDFYILNTNIPSTLSGVEYFWKVRNVGTEAIRRNCERGQIIKGNAKKHENTTFKGLHYVECYAVYNGVVIARGRIEVPIDPYLGVV

SEQ ID NO: 5133 - protein, 432 aa, Streptococcus parasanguinis
MSLATYFRDYCENVLPFDYSEFEKWDNRLKEITKKLNKKYYSDENIEDLEVENRYVVGSVGRGTAVSKTSDFDCIFKLPQDVFVRFDNRSNNGQSELLQEVREVVKSRYGLTDIKGDGQVVSIQFKASPKGVIELVPAFEQKNGDFKYPCSHNGGSWKITKPTPEINECKRLDNDTEGHFINFCRLLRQWKNNNGIVFKGLLIDTLVSEYFQLEVKYQLNYTDYEKHVPKLFKFLSEQDSAKKYWFALGSNQIILNDDNGKFIKKAEKVYDLLVNSNNLIEDYRKVFGNKFATSVSSEQNSKLSNEQFIEDMFPIQISYEIKLDCYITQKGFQKHSLREFLKKKLKVKIRKNLDFFISSTNIPKELKGVKYFWKVRNVGEEAVRRNCQRGQIQKGGSEKYETSEFSGPHYVECYAVYEDVVIARDRINVPIV

SEQ ID NO: 5134 - protein, 437 aa, Lactobacillus reuteri
MTISSVFSNFCSSIKLTEDDHWLSRLRAITKKINGKYYSNENDDTSHRLLVGSIGRKTATNDASDYDILFSLPWDVYHRFDHYGNNGQKYLLQEVRNCIRERYPKTDIRGDGQVVDINFSDGLIEVVPGFENEDGSFKYPDSNDGGKWKITNPRPEKLCCDDDNQSSNGTFRDITRMIRVWKNHKGFVLKGLLIDTFIDEFYQENKEFVNDNSYSKYPLIMKKAFHKLSQKDSDQHYWHALGSNQIINNNDDSRFIEQAKKAFNKLDSIDLENKDEVLNAFSKLFGQRFSKLVNDSRNNSKEQFASDYFSGINIKGTFNIKCTVEQKGFQPHSFSYYLNNFHFILKHRRLKFQITDLDIPNLDTIKPAFYWKIRNYGAEAEARNQLRGEIFRGEKIHEESTLYRSMRHYVECYVVVNNIVIAKNRIIVPIGDNSNEK

SEQ ID NO: 5135 - protein, 432 aa, Lactobacillus mucosae
MSISNTFKEFCQSIKLVDNNVWTNRFKRITKKINEKYYDNPDDDSGHRLRVGSTGRYTATSDASDYDLLYSLPWSTYDRFDSHEHGQSDLLQEVKKCIKETYSKTDISADGQVVDVNFNNGLIEVVPAFENDDKSFQYPDTHKGGSWKTTNPRPEKDQCKDDDSNSAGTFRDLTRMIRVWKNHQGFVFQGILIDTLVHNFYKENKDDVNSLSYSSYPQLMYNLFQYLSKQDSDQTFWHALGSNQLIEVKDKHFIKKAEAACNSLDGIDMDDEDEVLDTFKSLFGYQFSKVANNSNASSNEEFASSFFRSIDIQGTFDIKCVVKRKGFRNHSIAFFKDNYSALFKSSQLVFCVENEKFPEKYEKSKVTYYWKIRNYGTEARKAECLRGMIKKGERTHIETTRYTNMHHYVECYAVVDDIVIARTKVIVPIGEE

SEQ ID NO: 5136 - protein, 431 aa, Lactobacillus reuteri
MSIGNTFKEFCQSIKLVDSDVWNDRFKKITKKINEKYYNSDDDSRHRLRVGSTGRYTATSDASDYDVLYYLPWDTYDRFDSHEHGQSDLLQEVKQCIKETYNRTDVRADGQVVDVKFNDGLIEIVPGFENDDKSFQYPDTHGGGSWKRTNPRPEKEQCKIDNINSNGTFRDLTRMIRVWKNHKGFVFQGILIDTLVHNFFEENKDIVNNTSYSDYPQLMYDLFKYLGKQDPKQIFWHALGSNQNIEAKDKQFIKKAKAACDDLAEVDLDDEDEVLDTFKDLFGYSFSKVTNNSNISSEEEFASSLFRSINIQGTFDIECTVKKSGFLDHGIAYFKHNYKALLKFSNLVFSVKNESFPEKYRKRKINYYWKVKNYGVEAKAARCLRGTIVKGERTHTETTRYTNMHHYVECYAVVDNIVIARSKVIVPIGDR

SEQ ID NO: 5137 - protein, 414 aa, Megamonas hypermegale
MKTTTKEIAKKLNKIYYDLDDNTSEHMYIVGSVGRGTSIKGASDLDLLFDLPSDIYKKYDNYGENSNGQSVLLQEVKNVLLERYPKTKISGDGQVVVIEFINYTVELVPGFKQNDGSFKYPDTHDKGSWKITNPMPEIKESRKMAEDTNNNFVYICNMVRSWKNHIGFKLGGLLIDTLVYKFLNENNKYKTINYDKYFDMIKCLFAYLKDLNKEQSYWYALGSNQKVYNCDNGKFITNARKAYDKISSYEGTESDVNNKLREIFGNDFSESISVVENQSELNVYRTEQFIEKMFPVDIRYNLNIDCEVTQKGFRSYCLRYMLANNIKLMKNKSLKFEIKGCDIPGGAKTCDIYWKVRNVGAEAIRLDRIRGQVIKTNSKIHREHTSFQGAHYVECYLVKNGVCIAKDRIEVPIN

SEQ ID NO: 5138 - protein, 447 aa, Clostridium lundense
MGLKDDFQTFINNLETNNISEMETTVAEIAKKLNNYYYGLEGDTISHMYIVGSVGRGTSIKEVSDLDIIFDLPNEVYKRFNSYKNNGQTALLQDVKEVLKVRYPKTDISGDGQVVVINFNAYTVELVPGFKQSDDRFKYPDTHDGGSWRYTDPLPEIAESKKAAEDTDNNFKYIANMLRSWKNKQGFKFGGLLIDTLTYNFLNEKTEYKNIEFDDYLEMTKELFSYLKGLNKEQSYWFALGSNQHVDNCENGKFITKADKAYKKIKDLTEESTNVNKKLIEVFGVQFPKKQIQTNESRNAFSSYFEKSYRHTEEFIEDLFQEDIRYSLKIDCKVTQNGFRPTFLSLILNNNKYLGIKKKLEFFIDRIDKKLANESYDIYWKVKNEGEIAIEKDCIRGQILKTNNSTQKETSDFKGEHYVECYIVKDGICVAKDHLGVPISNCEYSMG

SEQ ID NO: 5139 - protein, 447 aa, Clostridium botulinum
MGLKNDFQTFIKNLETNNISEMKTTVAEIAKKLNNYYYGLEGDTISHMYIVGSVGRETSIKGVSDLDIIFDLPNEVYKRFNSYESNGQTALLQDVKEVLRVRYPKTDISGDGQVVVINFNAYTVELVPGFKQSDDRFKYPDTHDEGSWKYTDPLPEIAESKKAAEDTDNNFKYVANMLRSWKNKQGFKFGGLLIDTLTYNFLNEKIEYKNIGFDDYLEMTKELFNYLKDLNKEQSYWFALGSNQHVDNCENGKFITKADKAYKKIKDLTEESTNVNKKFIEVFGTQFPKKQIQTNESKNAFSSYLEKNYMHTEEFIEDLFQEDIRYMLKIDCKVTQNGFRPTFLSLILNNNKYLGIKKKLEFFIDTMDKKLANESYDIYWKVKNEGEIAIEKDCIRGQILKTNNSIKKETSDFKGEHYVECYIIKNGVCVAKDHLEVPISDYEYSIG

SEQ ID NO: 5140 - protein, 446 aa, Clostridium botulinum
MSLKDDFQTFTNNLKPNNINEMKTTVGEIAKKLNNYYYELEGDTTSHMYIVGSVGRETAIKGVSDLDILFDLPDETFKKFDAYKEKKQSSLLQEVKKVLQDRYSNTDISGDGQVVAINFTKYTVELVPGFKQSDDSFKYPDTNDGGSWKYTDPLPEIDESKKTAEDTDDNFKYIANMLRAWKNKHGFKFGGLLIDTITYKFLNERTDYKKIGFNSYLEMTKALFEYIKGLNKKQAYWFALGSNQEVYNCDNGKFITKAEKAYKKIKDLREGSSNVNKKLREVFGSQFPKKQSTENKIITASYSERRYMDTEQFIEDLFPVDIRYNLKIDCRVTQNGFRPTLLRLILKSHKYLGVKKHLEFYIDEIDDRLVFAEPYDIYWKVKNEGEIAIQKDCIRGQIKKTNNPTKIESSDFKGKHYVECYIIKDGVCVAKGHLNVPISNYEYIMG

SEQ ID NO: 5141 - protein, 446 aa, Clostridium botulinum
MSLKDDFQTFTNNLKPNNINEMKTTVGEIAKKLNNYYYELEGDTTSHMYIVGSVGRETAIKGVSDLDILFDLPDETFKKFDAYKEKKQSSLLQEVKKVLQDRYSNTDISGDGQVVAINFTKYTVELVPGFKQSDDSFKYPDTNDGGSWKYTDTLPEIDESKKTAEDTDDNFKYIANMLRAWKNKHGFKFGGLLIDTITYKFLNERTDYKKIGFNSYLEMTKALFEYIKGLNKKQAYWFALGSNQEVYNCDNGKFITKAEKAYKKIKDLREGSSNVNKKLREVFGSQFPKKQSTENKIITASYSERRYMDTEQFIEDLFPVDIRYNLKIDCRVTQNGFRPTLLRLILKSHKYLGVKKHLEFYIDEIDDRLVFAEPYDIYWKVKNEGEIAIQKDCIRGQIKKTNNPTKIESSDFKGKHYVECYIIKDGVCVAKGHLNVPISNYEYIMG

SEQ ID NO: 5142 - protein, 446 aa, Clostridium botulinum
MSLKDDFQTFTNNLKPNNINEMKTTVGEIAKKLNNYYYELEGDTASHMYIVGSVGRETAIKGVSDLDILFDLPDETFKKFDAYKEKKQSSLLQEVKKVLQDRYSNTDISGDGQVVVINFTKYTVELVPGFKQSDDRFKYPDTNDGGSWKYTDPLPEIDESKKTAEDTDDNFKYIANMLRAWKNKHGFKFGGLLIDTITYKFLNEKTDYKKIGFDSYLEMTKALFEYIKGLNKKQAYWFALGSNQEVYNCDNGKFITKAEKAYNKIKDLTESSSNVNKKLREVFGSQFPKKQSTENKVITASYNERRYRDTEQFIEDLFPVDIRYNLKIDCRVTQNGFRPTLLRLILKSHKYLGVKKHLEFYIDEIDDRLVFAEPYDIYWKVKNEGEIAIQKDCIRGQIKKTNNPTKIESSDFKGKHYVECYIVKDGVCVAKGHLNVPISNYEYIMG

SEQ ID NO: 5143 - protein, 444 aa, Paeniclostridium sordellii
MGLKDDFKTFVNNLEPTNITDMETTVGEIAKKLNNHYYNLTSDSTSHMYIVGSVGRTTSIKGGSDLDIVFDLPNNVYKKYDVYESNGQSALIQEVKSVLKVRYPNTDVSGDGQVVVIKFSNYTVELVPGFKQSDDRFKYPDTNNGGKWKYTDPLPEIEESKSTADDTTENFRYIAYMLRAWKNKQGFKFGGLLIDTLTYNFLNSKTEYRNIGFDSYLDMTKELFKYLKGLNKNQSYWYALGSNQQVYNCDKGKFITKAKKAYKKIEDLTEESSNVNKELRKLFGTKFPKKSIEESRSSYLYNMSKSYSETEQFIEEMFQIDIRYSLNIDCKVTQDGFMPRLLSCIIKNHMYLQPKKRLEFFIEDIDNQIKGKYDIYWKVKNEGKVAKDRNCIRGQIKKHNKTKIYETTDFIGEHYVECYIVQDGICIAMDRIDVPISTYQYEMG

SEQ ID NO: 5144 - protein, 420 aa, Firmicutes bacterium
MKKTTGEIAKKLNKSYYNLTDEKEEHMYIVGSVGRNTAISGNSDLDILFDLPASVYSRYDTYEGNGQSALLQDVKKVLQEKYPNTDIRGDGQVVVIAFNKYTVELVPGFKQSDDRFKFPDTHDGGKWKYTDPLSEQSACAECESESEGKYYDFCHILRSWKNHIGFKMGGLLIDTLTYDFFEENDLFIGDSEKNYLEILISLFEYLKNQDKNRSYWYAMGSNQCVYNSDNGKFVSKAKNAYDKIKNLTIESDNANKILRQVLGNSFPKAEGKTERSAQYAYIKKYYDRGASTEEFIDEIFDVDIRYALDIDCNVTQDGWRPFLLRKYLNESMLPLRKNKKLDFYIVDTDCPKPYDVYWKVRNVGLEAIKRNMVRGNICKESGSHHIENTEFEGEHYVECYLVKNNVCVARDKIEVPIGTL

SEQ ID NO: 5145 - protein, 262 aa, Stomatobaculum longum
MSLSKDFENFCKAIRLDNLSDMESTAGDIAKKLNNYYYELDGDSESHMYIVGSIGRKTAIAGSSDLDILFNLPNSVYKKYDNYKSNGQSALIQDVKKAVQERYPNSDISGDGQVVVIAFNKYTVELVPGFKQSDDRFKYPDTHDGGSWKYTDPLSEQDECENCNSDSNGTYYDFCHILRSWKNTIGFEMGGLLIDTLIYNFFQENEDFKDSSTDDYLKILTDLYKYLENQNPDQSYWLAVGSNQQVSNTDNGAFVSKAEKAI

SEQ ID NO: 5146 - protein, 428 aa, Alloscardovia macacae
MTLAEDFEQFCKEIQLDNLNDMKNQAAKIAKKLNKHYYGIDGDDDSHMYIVGSVGRGTAIKGSSDLDLIFDLPNDVYKQFDAYKENGQSALLQDVKKVMQESYPRTTIRGDGQVVVIEFDKYRVELVPGFKQNDGSFKYPDTHDSGSWKYTNPIIEQKECSLCNDKSYGVYYDFCHIMRSWKNTIGFKWGGLLIDTLVYNFFKKNDWFAGKDSNDYLEILKNLFEYLKNQDKSHAHWYALGSNQKIYGSRNEKFVVKAEKAYKELQDITEADKKINDVLRSLLGKRFPKIKDRSAEFSTTEQFIEDFVPVDIRYDLEIDCLVTQDGWRPFKLRKFLQNNTLLRHKKKLTFFIKDTSNPSQDYDIWWKVRNVGEVAIERSMTRGQLIRSNEKKQVEHTNFRGPHYVECYLLEDGICVARDRIEVPIGNE

SEQ ID NO: 5147 - protein, 438 aa, Desulfotomaculum ferrireducens
MSLSDDFNTFCNDILLKNRADMETSAGEIAKKLNNVYYDLSSEKEEHMYIVGSVGRESAIKGSSDLDLIFDLPNETYKKFDNYTGNGQSALLQEVKDHLKERYPKTKLRGDGQVVVIEFTNYTVELVPGFKQSDGKFKYPDTHDGGSWKKTDPIPEKEESKNFDIETGGNFLNFCHTIRAWKNKKGFKFSGLLIDTLVYNFFNDNTSYKAVGYDAYLEVLKELFNYLKGLNKQQSYWYALGSNQHVYNTDNGNFIDKAKEAYEEIKDLDEESENINDVLRNLLGTEFPKKEVATEQANLYKGLYTRKYRNTEEFIERKFPVDIRYNLVIDCKVTQDGWRDQWLSAILKQRGLLRINKKLDFYIDYTDAPEPYDIYWKVKNEGEVAIQKDCIRGQVIRTNNKHQKERTDFKGPHYVECYLVKNNVCVARARINVPIGNF

SEQ ID NO: 5148 - protein, 434 aa, Butyrivibrio sp.
MKLSLSSDFKQFCKKIKLDDSAMRTTAGEIAKKLNKVYYDIIGEESDHMYIVGSVGRKTAIKGSSDLDLLFVLPQEIYDKYNGYESGGKSQLLQEVKKVLKERYPKTDISGDGQVVVIDFDAYTVELVPAFINDESSFIYPDTHDGGSWKITKPILEQEACNDFDDSSNGAFRDFTGILRAWKNNVGFSFSGLLIDTLVAEFFEDNDSFENATYYDYREMLLNLFSFLKEEDSNQSYWFALGSNQHVSDKGKGKFVEKAKQAYDKLVEANDNNINEVLRGILGYDFPKFEKDQQIYNYKKFRNTEEFIMDKFPVDIIYNLDIDCEVKQDGWRPNLLSKIIKTDGFLKIDKNLEFMIMSTDCPQPYDIYWKVRNVGREAEIRDDIRGQIVKGQTSHREHSLFKGPHYTECYLVKSGVCVAKARIAVPIKNQSTVT

SEQ ID NO: 5149 - protein, 432 aa, Butyrivibrio sp.
MSLSSDFKQFCKKIKLDDSAMRTTAGEIAKKLNKVYYDIIGEESDHMYIVGSVGRKTAIKGSSDLDLLFVLPQEIYDKYNGYESGGKSQLLQEVKKVLKERYPKTDISGDGQVVVIDFDAYTVELVPAFINDESSFIYPDTHDGGSWKITKPILEQEACNDFDDSSNGAFRDFTGILRAWKNNVGFSFSGLLIDTLVAEFFEDNDSFENATYYDYREMLLNLFSFLKEEDSNQSYWFALGSNQHVSDKGKGKFVEKAKQAYDKLVEANDNNINEVLRGILGYDFPKFEKDQQIYNYKKFRNTEEFIMDKFPVDIIYNLDIDCEVKQDGWRPNLLSKIIKTDGFLKIDKNLEFMIMSTDCPQPYDIYWKVRNVGREAEIRDDIRGQIVKGQTSHREHSLFKGPHYTECYLVKSGVCVAKARIAVPIKNQSTVT

SEQ ID NO: 5150 - protein, 427 aa, Pseudobutyrivibrio sp.
MSLSSDFKEFCKNIKLDDSAMRTTAREISKKLNKEYYDISGEETEHMYIVGSVGRKTAIKGSSDLDLLFVLPDDVYDKYNGYESGGQSQLLQEVKNVLKERYPKTDISGDGQVVVIEFDAYTVELVPAFINDASSFIYPDTHDGGSWKVTKPLLEQAACDDYDDSSNGAFRDFAGILRAWKNNIGFSFSGLLIDSLVAEFFEKNDLFEGATYYDYREMLLNLFGFLKDEKSNQSYWFALGSNQHVSDKGNGKFVKKAQIAYEKLKESSDDNLNEALSEILGCDFPKSDKAVRAYNLSNYKNTEEFIKDKFPVDIVYNLRIDCEVKQDGWRTNLLSKIIKDDGFLKIDKSLEFMIMSTDCPQPYDIYWKVRNVGDEAERRDDIRGQIVKGRSSHTEHSRYKGPHYTECYIVKHGVCVAKARINVPISG

SEQ ID NO: 5151 - protein, 435 aa, Lactobacillus equi
MSLANDFESFCNSKNFELSDEMDTTIKEITKKLNSKYYDLSSEEKDHMYIVGSMGRMTAVKNSSDLDLLFDLPNSLFSKYDSYESNGQSELLQNVKEILKERYPKTFIKGDGQVVVIEFTKYTVELVPAFKQSNGRFKYPDTHNGGSWKYTDPLSEQKECMESSKKSSGAFINFCHIIREWKNNEGFKFGGLLIDTFVFNYLNSCTFEDDYSFDNYLEIFKSILDYVGKLDKNQSYWYALGSNQKIFNNSKGNFVSKAKKTLKQIQDAESNEDDMNNVLREILGNDFPKSESSKFLTEESLAFKKAYDNTEEFIEDVFPVDIRYSLQIDCRISQNGFRTFWLRKSPNMYIGIKKELRFSVTSTDCRDYDVFWKVRNVGNEAIRRNCIRGQIVKGNNQKIEHSQFNGNHYVECYLVKNEVCVARSRIDVPISTLFN

SEQ ID NO: 5152 - protein, 435 aa, Lactobacillus hayakitensis
MSLANDFESFCNSKNFELSDEMDTTIKEITKKLNSKYYDLSSEEKDHMYIVGSMGRMTAVKSSSDLDLLFDLPNSLFSKYDSYESNGQSELLQNVKEILKERYPKTFIKGDGQVVVIEFTKYTVELVPAFKQSNGRFKYPDTHNGGSWKYTDPLSEQKECMESSKKSSGAFVNFCHIIREWKNNEGFKFGGLLIDTFVFNYLNSCTFEDDYSFDNYLEIFKSILDYVGKLDKNQSYWYALGSNQKIFNNSKGNFVSKAKKTLKQIQDAENNEDDMNNVLREILGNDFPKSESSEFLTEESLAFKKAYDNTEEFIEDVFPVDIRYSLQIDCRISQNGFRTFWLRKFPNMYIGIKKELRFSVTSTDCRDYDVFWKVRNVGNEAIRRNCIRGQIVKGNNQKIEHSQFNGNHYVECYLVKNEVCVARARIDVPISTLFN

SEQ ID NO: 5153 - protein, 439 aa, Lactobacillus fermentum
MSLANDFESFCGSKNFELSDEMDTAIKEITKKLNSKYYDLSSEEKDHMYIVGSMGRMTAVKSSSDLDLLFDLPDSLFSKYDSYGSNGQSELLQNVKEILMERYPKTFIKGDGQVVVIEFTKYTVELVPAFKQSDGKFKYPDTHNGGSWKYTDPLSEQNECMESSKKSSGAFINFCHIIREWKNNEGFKFGGLLIDTFVFNHLNSCAFEDDYSFDNYLEILKNILDYVGGLDKNQSYWYALGSNQKIFNNSKGNFVSKAKKTLKQIQDAESNEDDMNDVLREILGNDFPKSESSELLTEESLAFEKTYDNTEKFIEDVFPVDIRYSLQIDCCISQNGFRTFWLRKFPNKYIGIKKELKFSVTSTDCQDYDVFWKVRNVGNEAIRRNCIRGQIVKGNNQKIEHSQFNGNHYVECYLVKNGVCVARDRIDVPISMNVSLDRK

SEQ ID NO: 5154 - protein, 439 aa, Lactobacillus kunkeei
MSLANDFESFCGSKNFELSDEMDTAIKEITKKLNSKYYDLSSEEKDHMYIVGSMGRMTAVKSSSDLDLLFDLPNSLFSKYDSYESNGQSELLQNVKEILKERYPKTFIKGDGQVVVIEFTKYTVELVPAFKQSDGKFKYPDTHNGGSWKYTNPLSEQHECMESSNKSSGAFINFCHIIREWKNNEGFKFGGLLIDTFVFNCFNKCKFKDDYSFANYLEILKNILDYVGKLDEDQSYWYALCSNQKIFNNNNGNFVSRAKKALRKIQDAESNEENINDVLREILGNDFPKSENSEFITEKSLAFEKTYDNTEEFIEDVFPVDIRYSLQIDCCISQNGFRTFWLRKFPNKYIGIKKELKFSVTSTDCPDYDVFWKVRNVGNEAIRRNCIRGQIVKGNNKKIEHSQFNGNHYVECYLIKNGVCVARDRIDVPISMNVSLNRK

SEQ ID NO: 5155 - protein, 437 aa, Bacillus cereus
MLSDSFSEYVESLEVDNLEDIDKKYKRITKKLNQSFWDLESDEEHAHKVGSLGRGTAIKGISDLDMLFILPDALYTQYNNHEGNGQSKLLQRVKEVIKATYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFVYLKNQSETRKYWLALGSNQQVYDKKKTFIKKAKKAHGKLESLSEESEEIYDILQELFGQGFPAPEGIQEVTKSAFASYEYSKTEQFIEKLFPVDIRYSLAINANVLQDGFREGSLSDFIMKRFPLKTKKQLKFYIEQNVVAELELPYTVYWKVRNVGIEAVKRNMIRGEISQDTGNEQITETTDFRGSHYVDCYIIHNEVCVAKDRIKVPIAIA

SEQ ID NO: 5156 - protein, 437 aa, Bacillus thuringiensis
MLSDSFSEYVESLEVDNLEDIDKKYKRITKKLNQSFWDLESDEEHAHKVGSLGRGTAIKGISDLDMLFILPDALYTQYNNHEGNGQSKLLQRVKEVIKVTYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFVYLKNQSETRKYWLALGSNQQVYDKKKTFIKKAKKAHGKLESLSEESEEIYDILQELFGQGFPAPEGIQEVTKSAFASYEYSKTEQFIEKLFPVDIRYSLAINANVLQDGFREGSLSDFIMKRFPLKTKKQLKFYIEQNEVAELELPYTVYWKVRNVGIEAVKRNMIRGEISQDTGNEQITETTDFRGSHYVDCYIIHNEVCVAKDRIKVPIAIA

SEQ ID NO: 5157 - protein, 437 aa, Bacillus cereus
MLSDSFSEYVEGLEVDNLEDIDKKYKRITKKLNQSFWDLESDEEHAHKVGSLGRGTAIKGISDLDMLFILPDALYTQYNNHEGNGQSKLLQRVKEVIRATYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFAYLKNQSETRKYWLALGSNQQVYDKKKTFIKKAKKAHGKLESLSEESEEIYDILQELFGQGFPAPEGVQEVTKSAFASYEYSKTEQFIEKLFPVDIRYSLSINANVLQDGFREGSLSDFIMKRFPLKTKKQLKFYIEQNEVSELELPYTVYWKVRNVGIEAVKRNMIRGEISQDTGNEQITENTDFRGSHYVDCYIIHNEVCVAKDRIKVPIAIA

SEQ ID NO: 5158 - protein, 437 aa, Bacillus sp.
MLSDSFSEYVEGLEVDNLEDIDKKYKRITKKLNQSFWDLESDEEHAHKVGSLGRGTAIKGISDLDMLFILPDALYTQYNNHEGNGQSKLLQRVKEVIKATYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFAYLKNQSETRKYWLALGSNQQVYDKKKTFIKKAKKAHGKLELLSEESEEIYDILQELFGQGFPAPEGVQEVTKSAFASYEYSKTEQFIEKLFPVDIRYSLSINANVLQDGFREGSLSDFIMKRFPLKTKKQLKFYIEQNEVAELELPYTVYWKVRNVGIEAVKRNMIRGEISQDTGNEQITETTDFRGSHYVDCYIIHNEVCVAKDRIKVPIAIA

SEQ ID NO: 5159 - protein, 437 aa, Bacillus thuringiensis
MLSDSFSEYVESLEVDNLDDIDKKYKRITKKLNQSFWDLESDEEHAHKVGSLGRGTAIKGISDLDMLFILPDALYTQYNNHEGNGQSKLLQRVKEVIKATYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFVYLKNQSETRKYWLALGSNQQVYDKKKTFIKKAKKAHGKLESLSEESEEIYDILQELFGQRFPAPEGVQEVTKSAFASYEYSKTEQFIEKLFPVDIRYSLSINANVLQDGFREGSLSDFIMKRFPLKTKKQLKFYIEQNEVVELELPYTVYWKVRNVGIEAVTRNMIRGEISQDTGNEQITETTDFRGSHYVDCYIIHNEVCVAKDRIKVPIAIA

SEQ ID NO: 5160 - protein, 437 aa, Bacillus toyonensis
MLSDSFSEYVESLEVDNLDDIDKKYKRITKKLNQSFWDLESDEEHAHKVGSLGRGSAIKGISDLDMLFILPDALYTQYNNHEGNGQSKLLQRVKEVIKETYPRTIVRGDGQVVVVSFSNYQIEVCPCFSENDGSFTYPDSNNGGKWKKTDPMPEIRESLAMTVDTDTHYRYICNMMRAWKNEAGFKFGGLLIDTLVYDFFEEYADYKECSFEDYLPILKDLFVYLKNQSETRKYWLALGSNQQVYDKKKTFIKKAKKAHGKLESLSEESEEIYDILQELFGQRFPAPEGVQEVTKSAFASYEYSKTEQFIEKLFPVDIRYSLSINANVLQDGFREGSLSDFIMKRFPLKTKKQLKFYIEQNEVVELELPYTVYWKVRNVGIEAVTRNMIRGEISQDTGNEQITETTDFRGSHYVDCYIIHNEVCVAKDRIKVPIAIA

SEQ ID NO: 5161 - protein, 437 aa, Unknown
  Description of Unknown: Bacillus sequence
MLSDSFSDYIESLAVDNLEDIDKKYKRITKKLNQSFWSLENDEEHAHKVGSLGRGTAIKGVSDLDMLFILPDALYTQYNNHEGNGQSKLLQRVKEVIKETYPRTIVRGDGQVVVVSFSNYQIEVCPCFSENDGSFTYPDSNNGGKWKKTNPMPEIRESLSMTKETNTHYRYICNMTRAWKNEVGFKFGGLLIDTLVYDFFEEYAGYKECDFDDYLSLLKDLFAYLKNQSETRKYWLALGSNQQVYDKKKVFIKKAKKAYGKLESLSEDSEDIYDVLQGLFGQNFPVPEKLQEIAKRAFISYEYNNNEQFIEELFPVDIRYSLVINANVLQDGFREGSLSNFIMKRFPLKTKKKLKFYIEQNEVAELELPYTVYWKVRNVGIEAVKRNMIRGEISQDTGNEQITETTDFKGSHYVECYIIQNEVCVAKDRIKVPIAIA

SEQ ID NO: 5162 - protein, 437 aa, Bacillus cereus
MLADSFSDYAESLEVDNLEDIDKKYKRITKKLNQSFWDLESDEEHAHKVGSLGRGTAIKGVSDLDMLFILPDALYTQYNNHEGNGQSKLLQRVKEVIRETYPRTIVRGDGQVVVVSFSNYQIEVCPCFSENDGSFTYPDSNNGGKWKKTDPMPEIRESLAMTEETDRHYCYLCNMLRAWKNETGFKFGGLLIDTLVYDFFEEYTGYKECSFEDYLSVLKDLFAYLKNQSETRKYWFALGSNQQVYDKKKTFIKKAKKAHEKLDPLSEDSEDIYDILQELFGQNFPVPEELQEITKSAFASYQYVNNEQFIEELFPVDIRYNLTVNANILQAGFREGSLSDFILKRFPLKTKKQLKFYIEQNETDELELPYTVYWKVRNVGIEAVRRNMIRGEISQDTGNEQITETTDFRGSHYVECYIIHNGVCVAKDRIKVPIAIA

SEQ ID NO: 5163 - protein, 447 aa, Paenibacillus sp.
MLETAFEEYCESLEIDNMESITKRYSEIVKRLNKSYWDSEDDEEHGYLVGSLGRHTAIKGVSDLDMLFVLPDSVYSEYNSKEGNKQSKLLQAVKKEIKKRYPRTTVRGDGQVVVVKFESINYIAEVCPVFAESDGSFTYPDSNNGGSWKKTNPIPEISESEIINDETNDHYRHICNMIRAWKNEQGFKFGGLLIDTLVYDFFNEKAERKNIKFTDYLATFKELFEYLKNLKEDRKYWFALGSNQKVYNKKCKFVKNAKTAFEKIKDLTVESNNLYSSLQLIFGESFSEPESTEEAVAKSLSSLSMNTNHTEQFIHSMFPVDIRFDLRIECEVTQDGFRNELLRKMKFLRPQKQLLFYIEDNEIDLLNSKIEDEEDKIEYEVYWKVLNRGEEAVRRNCIRGQIIKDQGKQTLKEASKFRGEHYVECYLVSNGICLARDKIIVPISEWL

SEQ ID NO: 5164 - protein, 446 aa, Bacillus sp.
MLATYIEEFVESLKIEDIEDETKRVKEITKRLNKSYYDGNESETENCYVVGSLGRGTAIKSFSDVDMLFVLPSSKKNQYNDHEGNGQSKLLQEVKKEIKKRYPKTIVRGDGQVIVVSFEKGTKIIEVCPVFQNSDGSFTYPDSNHNGKWKITNPLPEIAESVSFDLTTGKNYSNICYLVRAWKNNKGFKFGGLLVDTLVYNFLTENTQYHKANFNGYLDILKDLFGYLKDLNEEQSYWNALGSNQQVYNKKCKFVKNAKTAYEVIKDLNDESESEDINKSFVDLFGKNFPVPDTFTEGHIFMLNDIRPNNTEEFIEKKFNVDIRYSLKIECEITQNGYRTGLLREFLQKKLRIQNQKKLKFFIKENELEEVFKDNVIIQDKIKYDVYWKVLNRGDEAIRRNCIRGQITKGETAKTEHSVFNGDHLVECYIVYKNTVVARDQIQVPI

SEQ ID NO: 5165 - protein, 444 aa, Bacillus safensis
MLATYIEEFVESLKIEDIEDETKRVKEITKRLNKSYYDDNESETENCYVVGSLGRGTAINSFSDVDMLFVLPSSKKKQYNDHEGNGQSKLLQEVKKEIKKRYPKTIVRGDGQVIVVSFERGTKIIEVCPVFENSDGSFTYPDSNHNGKWKITNPLPEIAESVTFDLTTRKNFSNVCYLVRAWKNNKGFKFGGLLVDTLVYNFLTKNTQYQTATFIDYLDLLKDLFGYLKDLNEEQSYWYALGSNQKVYNKKCKFVENAKTAYEIIKDINEESENLYESFVDLFGKNFPIPDTVTESHIFFNNNSRVKNTEEFIEKKFNVDIRYSLKIDCKVKHKGFRPVEYLRKYLQKEPRIQHEKELEFYIEENEIDKLFENKFGEKIKYNIYWKVLNRGAEAIRRDCIRGQILPGEKTQVESSDFNGDHLVECYIVYRNTVVARDKILVPIQ

SEQ ID NO: 5166 - protein, 447 aa, Bacillus pumilus
MLAAYIEEFVESLKIEDIEEEMKRVKEITKKLNKSYYADNESETENCHVVGSLGRETAIKSFSDVDMLFVLPISKKKQYSDHESNGQKNLLQDVKNKIKERYPKTIVRGDGQVVVVSFKKVNKIVEVCPVFENEDGSFTYPDSNNGGKWRNTDPKPEIEESKLFNQTTNQNFNNVCYLIRAWKNNKGFKFGGLLVDTLVYKFLDENPKYQTATFIDYLDLLKDLFGYLKDLNEEQSYWYALGSNQKVYNKKCKFVKNAKTAYELIKDLNEESENIYESFVDLFGKHFPVPDTVTEKHIILLNDTRAKYTEEFIEKKFNVDIRYSLKIECEITQNGYRTGLLREFLQKEIRIQNQKELKFFIKKNELEEDFKDNVITHDKIKYDVYWKVLNRGDEAIRRNCIRGEITKGETTKTEHSVFNGDHLVECYIVYKNTVVARDQIRVPIQVV

SEQ ID NO: 5167 - protein, 460 aa, Bacillus sp.
MLATYMEEFIDSLKIEDTEEETKRVKEITKRLNKSYYDDCESETEHCEVVGSLGRQTAIKSFSDVDMLFILPSSKKKQYDDHDGNGQSKLLQDVKKEIKKRYPKTIVRGDGQVVVVSFESLKKIIEVCPVFEQSDDSFLYPDANEGGSWKKTDPIPEIDEANTFNITTNNNFSYVCYLVRAWKNNIGFKFGGLLIDTLVYKFLNENSKYYSATFADYLDLLKDLFKYLKDLNEEQAYWYALGSNQKVYNKKCKFVKKAKKAYNKIKDLGEDSTDLYETLVYLFGQTFPVPETVNKSVAYFESAYTRATNTEEFIENKFKVDIRYSLKIDCIIKQDGYRPAFLRDLLKSQNRIKRRKTLEFLIVENEFEKVIQERDSIKKLSSDEKFKFDIYWKVLNRGEEAIRRNCIRGQIIKGVEKRTEPANFNGDHFVECYIVYEDTVVARDRIHVPIQIENTLQRSF

SEQ ID NO: 5168 - protein, 450 aa, Bacillus licheniformis
MLGEKFEEFVDGLQIASIEEETKRVKEITKRLNKSFRDLDNEEIENSHIVGSLGRDTAIKTFSDVDMLYVLPKELKNQYDEYEGNGQSKLLQKVKQEIKKRYPKTIVRGDGQVVVVSFESINKTVEVCPCFERTDGAYDYPDSNNGGSWKKTDPMPEIDESIKVIDETNSNYKYVCNIVRAWKNNKGFKFGGLLIDTLVYNFFNENENYKDSTFDDYLSLLKDLFYYLKTRNKDQKYWYALGSNQKVYNKGGAFVNQAKKAYEKIKDKTEDSEDLYEKLQDIFGKAFPIPEEIQESNVIEKSALFGRSVRQTEEFIEHKFDVDIRYHLKIDCIVKQDGFRNKFLRNILRDKLPLKANKSLEFFITENEFETLSKDDEDNLYYEVYWKVLNRGEEAIRRDCIRGQIVRDKGTHKKFESTNFKGEHYVECYIVYKNVCVAKDRISVPISTIN

SEQ ID NO: 5169 - protein, 450 aa, Bacillus licheniformis
MLGEKFEEFVDGLQIASIEEETKRVKEITKRLNKSFRDLDNEEIENSHIVGSLGRDTAIKTFSDVDMLYVLPKELKNQYDEYEGNGQSKLLQKVKQEIKKRYPKTIVRGDGQVVVVSFESINKTVEVCPCFERTDGAYDYPDSNNGGSWKKTDPMPEIDESIKVIDETNSNYKYVCNIVRAWKNNKRFKFGGLLIDTLVYNFFNENENYKDSTFDDYLSLLKDLFYYLKTRNKDQKYWYALGSNQKVYNKGGAFVNQAKKAYEKIKDKTEDSEDLYEKLQDIFGKAFPIPEEIQESNVIEKSALFGRSVRQTEEFIEHKFDVDIRYHLKIDCIVKQDGFRNKFLRNILRDKLPLKANKSLEFFITENEFETLSKDDEDNLYYEVYWKVLNRGEEAIRRDCIRGQIVRDKGTHKKFESTNFKGEHYVECYIVYKNVCVAKDRISVPISTIN

SEQ ID NO: 5170 - protein, 450 aa, Salinibacillus aidingensis
MLEEKFEEYVDGLQIESIEEETKRVKEITKRLNKSFRNLENDEIENSHIVGSLGRDTAIKTFSDVDMLYVLPKELKKQYDEHEGNGQSKLLQKVKQEIKKRYPKTIVRGDGQVVVVSFESINKTVEVCPCFERSDGSFDYPDSNNGGSWKKTDPMPEIEESITTIEETNTNFKYICNLVRAWKNNKGFKFGGLLIDTLVYNFFNENEDYKSATFNDYLPLLKDLLCYLKDRNKDQKYWYALGSNQKVYNKGGTFVNKAKKAYEKIKDKTEDSDDIYEALRSIFGKAFPVPEEIKENKAFEKSALFGRYVRQTEEFIEDKFDVDIRYRLKIDCIVKQDGFRNKFLRNILRDKLPLKANKSLEFFITENEFESLSKDDEDSLYYEVYWKVRNRGEEAMRRDCIRGQIVRDKGTRKKIESTNFKGGHFVECYVVYRNVCVAKDKISVPISNSY

SEQ ID NO: 5171 - protein, 448 aa, Bacillus sp.
MLAQCFEEFVEDLQIESIDEETKRVREITKRLNTSYWDLECEEEENSHIVGSLGRVTAIKTFSDIDMLFVLPKELKKKYSDYIGNGQSKLLQDVKKEIKKRYPKTIVRGDGQVVVVSFKSINKTVEVCPCFERTDGAFDYPDSNHGGSWKKTDPMPEIDESKKTIDETNSNFKNICNLIRSWKNNYGFKFGGLLIDTLVYDFFKENEGYNDVTYDSYLSLLQDVFYFLKTRKKDQKYWYALGSNQKVYNKDGKFITKAEDVYEKIKDITEESENLYDVFQDIFGTAFPVPEEIQESNTIEKSSLFSRNVRQTEEFIEKKFDVDIRYQLKIECLVKQNGFRNMLLRKIVRDGFPLKASKTLEFYIESNEFDRLSKDEEEKLYYEVYWKVLNRGQEAIRRDCIRGQIVRDKGTHKKTETTDFRGDHYVECYIVYKNVCVARDRIKVPIST

SEQ ID NO: 5172 - protein, 449 aa, Anoxybacillus tepidamans
MLAQSFEGFVKQLEIDNLDDIHKRFKRITKRLNEAYWDTDSDQEHSYIVGSLGRQTAIKGISDLDMLFVLPNGVKQQYDQHEGNGQSKLLQAIKAEIKKTYPRTIVRGDGQVVVVSFESINYTIEVCPVFERSDGAFDYPDSNNGGSWKKTDPLPEIEESLKTIEETNNNYRYLCNIVRAWKNHIGIKFGGLLIDTLIYNFLDEYEEHKEAAFENYLQVLKDLFYYLKTRNKDQQYWFALGSNQKVYNKKGTFVTKANSAYNKIKDLTEDSENLYDTLQELFGETFPVPEAVSEAKIEKSASFGFTARQTEEFIERKFPIDIRYSLKIDCEVKQNGFRPHLLRNMLRDQIPLLANKNLRFFIEKNEFDKIARRSEEKLPYDVYWKVLNRGEEAILRDCIRGQIVRDRGRHEKIESTNFKGEHYVECYIVHNGTVVARDRITVPIANNQT

SEQ ID NO: 5173 - protein, 451 aa, Paenibacillus sp.
MLANAFEDFIEKLDIDNIEDIHKKFKRITKRLNEAYWGIENDEEHGYIVGSLGRQTAIKGVSDLDMLFVLPDHIKQQYDQHEGNGQSKLLQNVKKEIKETYPRTTVRGDGQVVVINLDSINYQIEVCPVFVRSDGAFNYPDSNNGGSWKKTDPLPEMDRSLITADETNGHYRNLCNIIRAWKNSVGFKFGGLLIDTLIYNFIEENTKYKNTNFTEYLQLLKDLFNYLKTRNKEQKYWFALGSNQKVYNKKGTFVTKAESAYDKLKDLTEESDDLYLVLQEVLGSDFPVPEQLQQTALQKSATFSLSANIRMTEEFVEKKFPVDIRYYLKIDCEVNQNGFREYLLRALIRARLPLLSNKKLRFFIEKNELEDISMASEEPISYDIYWKVLNKGPEAIKRDCIRGQIVADLGRHQRLEETSFRGEHIVECYIVLNGTVVAKDRILVPISTNVA

SEQ ID NO: 5174 - protein, 440 aa, Exiguobacterium sp.
MLAKAFEDFAGSIQVNNIEDINTKFISITKRLNLSYWETDSKTDHSYKVGSLGRQTAVKGVSDLDMLFVLPPNLYTKYNNYQGNGQSALLQSVKGEIKRKYPNTIIRGDGQVVVITFSRYVVEVCPVFERNDGSYTYPDSSNGGKWKRTDPLLEIGESKYMIEHTNENFKYVCQMVRAWKNHVGFKMGGLLIDTLVHNFFNRHPIYTSAEFHNYLSLFKDLFSYFKGLDKGQKYWNALGSNQQVYNKGGVFVEKAEDAYNELKDFNEDSENLYEVLQGLFGKNMPIPETLQKSAEGRDFTNTFLDKQQFIEELFPVDIKFSLEIDCEVKQNGFRETLLRTLLRNRSPLLINKELTFFVAKNEFEEKELPYEIYWKVRNRGSEAIKRNMKRGEILKGSETKVERTSFKGGHFVECYIIYNGVCVARDSIDVPIALDTYNSK

SEQ ID NO: 5175 - protein, 440 aa, Bacillus subtilis
MLSKSFELFLEDLQIDNRQDIETKFKSITKRLNTKYYGTNSDIDHAAMVGSIGRSTAIRNVSDLDMLFVLPQSVFNRFDNYESNGQKALLQEVKQEIKERYPHNSTIVRGDGQVVVVSFSNFEVEICPAFENKDGSFCYPDSNNGGSWKRTDPLVEIGESDYMISETNSNFKYVCQILRAWKNNIGVKMGGLLIDTLVHKFFHKNKKYFSITFDNYLELLIDLFGYLKGLDEEQKYWQAIGSKQHVYNKDKRFIKKAGKAYKKLKESNSNSDDLYIVLKELFGNNFPVVDSFKSNQLRYSTYYSPTEQFIENMFPVDIRYRLIIDCEIKQNGFRETMLKKLLRLKKPLLTNKELTFFIDYNEVEEKELSYEIYWKVKNQGEEAVKRGQLRGEIKKGGNKKIERTNFRGFHFVECYIIHSGICVARDFISVPIATHMAIRI

SEQ ID NO: 5176 - protein, 439 aa, Rhodococcus sp.
MLSQSFESFAENLQLDNTEDMETKFKSITKRLNKKYYESSSETDHAEMVGSIGRHTAIKTVSDLDMLFVLPQPVFDRFNSYESNGQSALLQEVKEEIKKRYPKTIVRGDGQVVVVTFTNFEIEICPAFLNSNDGSYTYPDSNQGGKWRRTDPLVEIGESEYMISETDSHFKYVCQMVRAWKNNIGFKMGGLLIDSLVHKFFRKNTKYLSATFDDYLNLFIDLFGYLKDLNEDQTYWRALGSRQPVYNKDKRFIKKAKTAYNKLKDFTSECEDLYDVLKELFGRSFPVPETIQKAEDIRYAMSYSPTEQFIEDLFPVDIKYSLKIDSEVSQDGFRTMLLRALIKNKKPLMINKSLHFFIKKNEVEEKELDFKVYWKVKNRGEEAKKKGQLRGQIVKGGNKKIEHSRYKGEHYVECYIIHNGVCVARDHIKVPISTAPVHA

SEQ ID NO: 5177 - protein, 451 aa, Bacillus megaterium
MLSQSFQQFMELLQIDNETDINTKFKSITKRLNTSYYPDNTSEEDHGYKVGSLGRQTAIKGISDMDMLFVLPKSKFKQYNDHKSNGQSALLQDVKEQIRKRYPNESIIVRGDGQVVVITFSNYEVEVCPAFENSDGSYKYPDSKKGGKWKRTDPMVEIGESEYMIGETNEHFKYICQMVRAWKNNAGFKMGGLLIDTLVHKFFNKYPQYMTVTFEDYLFLFQDLFQYLKSQDKEKKYWQALGSRQPVFDKSKDFISKAEKAYNKIKDLNEESEDLYENLQEVFGITFPVPETVQKAEFSSYAYRSIGAAATTEQFIERMFQVDIKYTLKIECEIKANGFRVGLLRNLIRNKKRLPLSRKLRFYIEENEFEKKRNGAPYYIYWKVRNRGPEAVKRKCLRGEIEKGTSEHVEITSFKGEHFVECYIISNGICVARDTIDVPIFETPFPMKVQS

SEQ ID NO: 5178 - protein, 467 aa, Saccharibacillus sacchari
MLKDSFKTFVESLAINVEKLNVDGTESEVEDQEDESSDDDPYYRIVNKLNSSYWQEESDEDHGHIVGSLGRKTAIKGISDMDMLFILPAEVKKDFDSRSENVQSQLLQEVKGRIKEIYPNTIVRGDGQVVVVSMKSAKCEIEVCPVFERSDGAFDYPDSNNGGSWKKTNPIPEMIEAEVMIDMTNAHYQNVCRMIRAWKNNKGFKFGGLLIDTLTYNFFSDEKYKHYQQCAFDDYLQLFTDLFGYLKEQDPQQKYWFALGSRQRVYNKNGKFISRAKKAYNKIKNCTEESDNVYESLQDLFGTAFPVPTNVIEASSFTQPFVGAVRNTEEFIDDMFQVDIRYELEIDCEVDIAGYRRRSLREMLALVLKLPAQKNLTFKITYNEFEEKYRSIRPDDQQRYSSYRVYWKVLNQGTEAIRRDCIRGQIRSGGETKTEITSFKGDHIVECYIVHDQVVVAKDRIRVPINP

SEQ ID NO: 5179 - protein, 435 aa, Staphylococcus saprophyticus
MGIENAFAEFIDDLQDIDMEDKDKRMKRITKKLNKVYYNGNESEEENFILVGSLGRHTAIKGVSDVDIAFVLPNSIYKKYNDRKNNGQSELLQDIKKTLSELASRTIVRGDGQVVVLEFSNYTVELCPYFYKDENTYIYPNSNNGGSWKTTQPILEITESEKMMDETHNNYQAVCNLTRAWKNKVGFKFGGLLIDTLVCNFFNSHSDYKNSEYYDYPQLLKDFFYYLKNLNKDQSYWLALGSNQKVYNKDGQFVSKAKKAYDKIIDVENNSIEMHEKMKELLGSKFPNQIEERVHKSLSEDYNFDDTEEYIEGQYPVDIRYNMEIKCDVDQDGWRKTPLRKLKFLHANKKLEFSIEVPEEVKEPYEVKWKVKNIGSLAREKNMIRGQIIDGNRDKHTHTETTQFKGPHFVEAYIILNNTVVAKDRISVPINISRN

SEQ ID NO: 5180 - protein, 439 aa, Unknown
  Description of Unknown: Bacillus sequence
MGIEAAFEEFVEYLQDIKLEDKETRLKRITKKLNKTYYEGNDSEVEHFLLVGSLGRHTAINGVSDVDAAFVLPREVYNQFNKRSGNKQSQLLQDVKSTLLELSPRTIIRGDGQVVVLEYKDYDVELLPCFELEDGSFLYPDSNNGGRWRTTNPLPEITASEIKIDETNGHFKNVCNLVRAWKNQQGFKMGGLLIDTLVYKFFNQNTKYNEAEFSDYPQLLKDLFYFLKELDKEQEYWKALGSNQHVYNKDGKFVTKAKNAYNKIKDIGNDSNEMYAKMQELFGTKFPNLVEEQVEKSLFTQFASKNTEEFIEDRYPVDIRYSVSIDCFVSQDGWRDRTPLRHLPFLRSDKRLEFSIEPLDVDWDYDVLWKVRNVGEIAHQRDKIRGEITEGNLGKYRHKERTEFKGEHYVEVYIIKNGIVVARDKIDVPINIDRARISV

SEQ ID NO: 5181 - protein, 428 aa, Adhaeribacter aquaticus
MDIAKIFGGFVNNLVIENQTNIESRFATITKRLNLDFYGLNSNTENGIYIGSYGRNTAINGVSDLDIIFELPSELYYQYNNRVGNKQSQLLQDVRNSISKTYSQSKVRGDGQVVVVEFKSDFIEVCPAFKETDNSFTYPDSNYGGSWKKTNPLPEAKAILELDKTSKSNLVNLCRIARAWKNKNGVKINGLLIDTFAYNFIKQNSYYATLGFDKYDEFVQGFFYYLKELDSNRKFWFAPGSNQKVYKKKSNFSSKAKKAYNLISEAIKNNESKTVYEIWRRVFGSQFPYPREIKELSLNFTNKEEFIEDKYPINIKNFLSIDCEVTQAGFRVGLLKEMVLLKKNKNLRFFIKQTDVSQPYEILWKVKNEGKLAYERGVHRGQIISSNLNGTDRTENSTFEGSHFVECYLIKDGFCVARDRIDVPILNG

SEQ ID NO: 5182 - protein, 428 aa, Pedobacter glucosidilyticus
MDTEQTFQDFSNNLVIQNQDSIENRFGLIIQRLNSDFHNIDSKTENGLYVGSYGRDTAINGISDLDLIFILPDSMFTTYNNREGNKQSQLLQDVRDSIKKTYSTSKVRGDGQVVVIEFTNDYIEVCPCFLESDGSFTYPDSNNGGSWKKTNPSPEASELNNYNNECNGNLIFLCRYIRAWKNKCGVKIGGLLIDTLVYNFFKSDTKYAKYNIDQHDILVRDFFEYLKNLNDDRKYWYALGSNQHVYKKNSNFKSRAKKALKNVEEAIEKQNNKTVYEIWRKVFGKVFPYPQAIKESSYNYSSTEEFIENKYPINISYGLRIDCLVNQAGFRSELLRQIRLLRKKKELIFFIDRTDVPEPYEILWKVKNEGEIAKQKDCLRGQIIKSNKDYSKRKENSNFEGAHYVECYIIKDGYCVAGDRIDVPISEG

SEQ ID NO: 5183 - protein, 428 aa, Myroides phaeus
MDTEQIFQDFSNNLIVNNQKSIENRFGLIIQRLNSDFHNLESKTENGIYVGSYGRTTAINGVSDLDLIFVLPDILYSQYNDRQGNKQSQLLQDVRDSIKKTYPSSKVRGDGQVVVIEFKNDFIEVCPCFLKSDGSYTFPDSNNGGTWKKTNPIPEALEINNYNNLCNKNLIILCRYIRAWKNKCGVKIGGLLIDTLVYDFFKSDTKYKEYTFEYHHLLIKDFFEYLANLNDNRVYWYAPGSNQHVFKKNSNFRSKAKKALKNIEEAIGKKDNKTVYEIWRRVFGRIFPYPQSIKEVSYNYSLSEEYIEDKYPLNISNTLRIDCLVNQSGFRTELLRQINFLRKKKELIFYIDKTDVVAPFEVLWKVKNEGEKAKEKNCLRGGIIDSNMEHNKRRENSNFEGMHFVECYIIKNGFCVARDRIDVPISDE

SEQ ID NO: 5184 - protein, 426 aa, Flavobacterium sp.
MNTSEIFKEFLNNLIIQNKEEISTKYNSITKRLNDSFHGVDSETLNSLQVGSYGRKTAVNGVSDLDMIFELSDETFKKYDNYETNGQSALLQDVKKEIIKTYTTTDVRGDGQVVVVNFTNYVVEVCPVFIQSDGTYKFPDSNNNGSWKKTNPRPEIKEINDYNTTTNGNLKNLSKICRAWKNKCGVKIGGLLIDTLCYEFLKNNENHHSTTYSNYDVFIKDFFCFLKDYDNKREYWFAPGSNQKVYKKKSNFVSKAKKAHSNVVEAIEKKENSTVYEIWKRVFGYPFPYPKTIKESSLNYTSSEEFIEDLYPVDIIYSLTINCEVSQAGFRSEYLKNMLDKLKVSKKLKFFIENTDVEEPYSIKWKVKNEGEIAKQKNNFRGQIFNGTNIRNETSSFGGSHFVECYIIKNNICVARDRIEVPISNI

SEQ ID NO: 5185 - protein, 428 aa, Lutibacter agarilyticus
MNTSEIFQQLLSNLIIKNKDQISRKYKNITKALNKDFFDDESEIKNSLQVGSYGRKTAVNGISDLDMLFELTPELFTKYDNLQNNGQSTLLQDVKSAILNTYSTTDIRGDGQVVVVSFTNDIVEVCPVFEQSDGSYKYPDTNNGGKWKKTNPKPEISEINSFNITTNSNLKNLAKMTRAWKNKCGVKIGGLLIDTLCYEFLVANTNHHTTTFSDYDIFVRDFFEYLKNLDKNRDFWYAPGSNQKVYKKKSNFISKAKKAHKNVLEAIDKENNSTVYTIWKKVFGYPFPYPSIIKEQSIDYTENEEFIEDLFPVDIITSMRINCEVNQPGFRVEFLRNMYSKLKINKKLKFYIESNDVKKPYLVKWKVKNEGSIAKSRNNLRGHILNDKGSEFRKENSNFAGAHFVECYIIKDNICVARDRIDVPISNI

SEQ ID NO: 5186 - protein, 163 aa, Planococcus sp.
MSVSDYFSTFCSNLRMSSDNVNKIQYRYKQITKRINTAYRGSTSETANSFYVGSYGRGTKIWTSDIDVMVQLPYQTYKKFNDYTGNGQSALLQEVKNELEKTYSTSHLNGDGQVIAINFSDGISFEIVPAFINDGGSYTYPDTNNGGSWKSTDPKKKLRPCII

SEQ ID NO: 5187 - protein, 292 aa, Peptococcaceae bacterium
MSVSDYFQTFCTNLRMSSETISKIQNRYRQITKRINLDYYNSSSETNNSLYVGSYGRGTEIFTSDIDIIVQLPYETYVKFNNYTSNGQSALLQEVKSVLQKTYSTSHLKGDGQVIGINFTDGINFEIVPAFVNTNGSYTYPNSNNGGSWEVTDPKSEIGAINSMNNETNKNLKRLCRMARAWKDKNSVSMNGILIDTLAYKFIKNWQYKDKSYLYYDFMSRDFFEYLKDLSTEQNYWLAPGSNRYVYKNGNFQNKAKNAFEDAKEAISYETNKHSYSSKQKWRGIYGTKFPE

SEQ ID NO: 5188 - protein, 292 aa, Clostridium beijerinckii
MSVSDYFQTFCINLRMSNDTVNAIQYRYHQITKRINLDYYNSSSETNHSLYVGSYGRGTEIFTSDIDMIVKLPYDTYVKFNNYSSNGQSALLQEVKGVLEKTYRTSDVKGDGQVIGINFTDGINFEIVPAFINENGSYTYPNSNNGGSWKVTDPKSEIDAMNSMNSESNRNLKRLCRMARAWKNKCNVPMSGILIDTLAYKFIKDWEHKDKSYLYYDYMSRDFFEYLKDLSIDQNYWLAPGSNRYVWKYDNFQNKSKKACDIAKEAISYETNNCPYTSKQKWREIYGTKFPE

SEQ ID NO: 5189 - protein, 292 aa, Staphylococcus saprophyticus
MRVYDDFSMFCSNLRMTNETTKKIRNRYNQITKRINNDYRNINSENSYSRYVGSYGRGTEIWTSDIDIIVILPYETYVRFNNYKGNGQSALLQEVKQSLQKTYSTSHSKSDGQVIGINFNDNISFEIVPVFLNKNGSYTYPDTHNDGTWKVTDPKPEISTINNFNKITDGNLKRLCRMTRAWKSHCNVPMNGILIDTLAYDFMKNWKYKKESYLYYDFMSRDFFNYLSNISPSQKYSFAPGSTKKVYIDDLFQAKARKAFNHAKNAIEYANNNKFYSSNQKWREIYGTRFPI

SEQ ID NO: 5190 - protein, 292 aa, Veillonella dispar
MSVSENFSTFCSNLRMSSDTVSKIQQRYQKITKRINLDYWGNQSETAHSLYVGSYGRGTEIWTSDIDVIVQLPYEVYTRFNAYSSNGQSAFLQEVKGVLQKTYSTSYIKGDGQVIGINFQDGINFEIVPAFINIHNSYTYPDSNDGGRWKITDPRKEIDAINERNYGSNKNLKRLCRMVRAWKEKCNVPISGILIDTLAYKFIENWTYKDKSYLYYDFMSRDFFYYLKNIDISKSYWLAPGSNRFVYKSGSFQSKATIAYNNALEAISYEDNNKFYSARYKWREIYGAKFPE

SEQ ID NO: 5191 - protein, 293 aa, Candidatus Stoquefichus massiliensis
MSVSDYFSTFCSNLRMSTDTVSKIQYRYHQITKRINTDYRNSSSETAYSLYVGSYGRGTEIWTSDIDMIVQLPYETYAKFNAYTSNGQSALLQEVKTVLQKTYSTSYVKGDGQVIGINFDDGINFEIVPAFINKDGSSYTYPDSNNGGSWKTTDPKKEIEAINDRNKLVNKNLKRLCRMARAWKKKCNVSMSGILIDTLAYKFINDWEYKDKSYLYYDYMSRDFFEYLKNIDTDKTYWLAPGSGRYVYKDGNFQSKAKTAYENALTAISYESNNQSYSAKQKWREIYGAKFPA

SEQ ID NO: 5192 - protein, 292 aa, Clostridium sp.
MSVSDYFSTFCSNLRMSSDTVSTIQYRYHQITKRINLDYRNSSSEIAYSLYVGSYGRGTEIWTSDIDMIVQLPYETYAKFDAYSSNGQSALLQEVKGVLQKTYSTSYVKGDGQVIGINFTDGINFEIVPAFINKDDSYTYPDSNDGGSWKTTNPRKEIAAMNTRNSNTNKNLKRLCRMARAWKEKCNVSMSGILIDTLAYKFIGDWEYKDKSYLYYDFMSRDFFAYLKNIDTSQNYWLAPGSNRYVWKSGNFQSKAKTAYDNAVAAISYESDNMSYSAKQKWREIYGTNFPE

SEQ ID NO: 5193 - protein, 292 aa, Streptococcus iniae
MSVTSNFTNFCNNLRMSGNTVDKIRNRYRQITKRINTDYRGNTSETSYSYFVGSYGRGTEIWTSDIDILVHLPFETYAKFNAYSGNGQSALLQEVRSVLQKTYSSSYVKGDGQVIGINFTDNINFEILPAFINKGGSYTYADSNGGGIWKKTDPKKEIEAINKRNAETNKNLKRLCRMARAWKYKCDVPISGILIDTLAYKFINSWGHKDKSYLYYDIMSRDFFEYLKDIDKSITFWLAPGSNRYVYKTGNFQSKAKTAYKNALSAIDYECRGMPKTARNKWRDIYGTKFPE

SEQ ID NO: 5194 - protein, 292 aa, Lactobacillus ruminis
MSVSDYFSTFCSNLRMDSDTVSTIQCRYHQITKRINLDYWNSSSETTHSLYVGSYGRGTEIWTSDIDIIVQLPYSTYEKFNAYKSNGQSALLQEVKGVLQKTYSTSYVKGDGQVIGINFSDGINFEIVPAFINTDGSYTYSDSNNGGSWRITDPKKEIDAMNSRNKDTSKNLKRLCRMARAWKENCNVSMSGILIDTLAYKFINDREYKDKPYFYYDFMSRDFFKYLKELDKDQSYWLAPGSQRYVWKNGEFHTKAKTAYNNAVSAISYENGNYSYSAKQKWREIYGTKFPE

SEQ ID NO: 5195 - protein, 290 aa, Clostridium butyricum
MSVSDNFKTFCSNLRMDSDTITKIQNRYHQITKRINLDYWNSNSEVNNSLYAGSYGRGTEIFTSDIDIIVRLPYETYEKFNNYTSNGQSALLQEVKEVLKKTYSTSFLKGDGQVICINFADGIDFEIVPGFINDDNSYTYPNSNNGGSWLVTDPRSEIDAMNELNKSTNKNLKRLCRMARAWKNKCNVPMSGILIDTLAYKFIKDWEYKDKSYVYYDWMSRDFFKYLKDIDKNQTYWLKPGSNRAVYKNGNFQNKALEAYNKSVDAISNENNEYKAKQIWREIYGTKFPS

SEQ ID NO: 5196 - protein, 290 aa, Clostridium butyricum
MSVSDNFKTFCSNLRMDSDTITKIQNRYHQITKRINLDYWNSNSEVNNSLYAGSYGRGTEIFTSDIDIIVRLPYETYEKFNNYTSNGQSALLQEVKEVLKKTYSTSFLKGDGQVICINFADGIDFEIVPGFINDDNSYTYPNSNNGGSWLVTDPRSGIDAMNELNKSTNKNLKRLCRMARAWKNKCNVPMSGILIDTLAYKFIKDWEYKDKSYVYYDWMSRDFFKYLKDIDKNQTYWLKPGSNRAVYKNGNFQNKALEAYNKSVDAISNENNEYKAKQIWREIYGTKFPS

SEQ ID NO: 5197 - protein, 290 aa, Clostridium botulinum
MSVSDNFKTFCSNLRMDSDTITKIQNRYHQITKRINLDYWNSNSEVNNSLYAGSYGRGTEIFTSDIDIIVRLPYETYEKFNNYTSNGQSALLQEVKEVLKKTYSTSFLKGDGQVICINFADGIDFEIVPGFINDDNSYTYPNSNNGGSWLVTDPRSEIDAMNELNKSTNKNLKRLCRMARAWKNKCNVPMSGILIDTLAYKFIKDWEYKDKSYVYYDWMSRDFFKYLKDIDKNQTYWLKPGSNRAVYKNGNFQNKALEAYNKSVDAIKNENNEYKAKQIWREIYGTKFPS

SEQ ID NO: 5198 - protein, 291 aa, Bacillus massilionigeriensis
MSVTDNFRTFCSNLRMSSDTINKIQSRYHQITKRINLDYWNSSSEVNHSLYVGSYGRGTEIFTSDIDIIVQLPYATYVKFNNYSSNGQSALLQEVKEVLKKTYSSSYLKGDGQVIGINFSDGINFEIVPGFLNSDNKSYTYPDSNNGGSWKTTDPRSEIEAMDKLNKDTNKNLKRLCRMIRAWKNTWNVPMSGILIDTLAYKFIKDWEYSDKSYTYYDWMSRDFFKYLKDINPSQQYWFAPGSNRYVWKTGNFQYKALQAYNKSLEAIENESNESKAKQKWREIYGTKFPR

SEQ ID NO: 5199 - protein, 293 aa, Clostridium perfringens
MSVNSNFESFCNNLRISDNKISDIRNRYHQITKRINIDYWTTSSDTNHSLYVGSYGRGTEIFTSDIDMVVELPYATYKKFNERSGNGQSDLLQEVKNVLKKTYSSSDLKGDGQIISIKFSDGINFEILPCFINNDGKSYTHADSNNGGAWRITNPRAEIDEINSLNKSTNKNLKRLCRMARAWKDNCNVPISGILIDTLAYKFLKTWEYKDKGYIYYDWMSRDFFKYLKNIDKTQVKWLVPGSNRYISEYGNFQNKAAIAYNKSLEAIEYEDKECPYSAKSKWREIYGTKFPS

SEQ ID NO: 5200 - protein, 291 aa, Lysinibacillus fusiformis
MSVSENFKSFCLNLRMSNDTTTKIQSRYKQITKRINLDYRNSTSETSNSLYVGSYGRGTEIFTSDIDMIVVLPFSTYNKFNNYTSNGQSALLSEVKEVLKKTYSTSFLKGDGQVIGINFTDGINFEIVPSFVNSDNKSFTYPDTHNGGSWKTTDPRSEIEAINKLNSDTNKNLKRLCRMIRAWKYNCNVPMSGILIDTLAYKFLKDWEYKDKSFLYYDFMSRDFFKYLKDIDKEKLYWLAPGSNRYVWKDGNFQSKALQAYNKSLEAISNEGNDSVAKQKWREIYGSKFPR

SEQ ID NO: 5201 - protein, 292 aa, Paenibacillus sp.
MSVSENFSQFCSNLRMSDSTVSTIQQRYKQITKRINLDYRDSSSETSYSLYVGSYGRGTEIWTSDIDVIVQLPYATYQKFNNYSGNGQSALLQEVKGVLQKTYSSSYIKSDGQVVGINFADNIDFEIVPAFINDGGSYTYPDTNDAGSWKTTDPRKEIDAMNTRNSSTNKNLKRLCRMARAWKKHCDVGMSGILIDTLAYKFIDDWEYKDKSYVYYDWMSRDFFEYLKDIDTDKTYWLAPGSNRYVYKDKNFQSKAATAYTNSLEAIEYESKDQFSSAKIAWRKVYGTKFPS

SEQ ID NO: 5202 - protein, 292 aa, Paenibacillus amylolyticus
MSVSENFSQFCSNLRMSDSIVSTVQQRYKQITKRINQDYWNNSSETSHSLYVGSYGRGTEIWTSDIDVIVQLPYATYQKFNNYSGNGQSALLKEVKEALQKTYSSSHVKGDGQVVGINFTDNINFEIVPAFINDADSYTYPDTNNGGSWKVTDPRKEIDAINTRNSSTNKNLKRLCRMARAWKNHCDVSMSGILIDTLAYKFIGEWENKDKSFLYYDWMSRDFFKYLKEIDKEKNYWLAPGSNRYVFKDKNFQSKAATAYDNSLTAIEYETKDQTSSAKLTWRKIYGTKFPS

SEQ ID NO: 5203 - protein, 292 aa, Bacillus thuringiensis
MSVSDYFSTFCSNLRMSSDTVGKIQYRYKQITKRINIDYWGSTSETTHSLYVGSYGRGTEIWTSDIDMIIQLPYHTYTKYDNYSSNGQSALLQDVKATLQKTYSTSHLKGDGQVIGINFTDGINFEIVPAFINKDSSYTYPDTNNGGTWRITDPRKEISTMDSRNNDTNKNLKRLCRMARAWKAKCNVPMSGILIDTLAYKFIKEWAHKDKSYLYYDYMSRDFFKFLKDIDKTKTYWLAPGSNRYVSKYGNFQAKASIAYNLSLEAIEHESNNRPYSAKQKWREIYGTKFPN

SEQ ID NO: 5204 - protein, 292 aa, Bacillus cereus
MSVSDYFSTFCSNLRMSSVTVSDIQYRYKQITKRINIDYWDSTSETAHSLYVGSYGRGTEIWTSDIDMIVQLPYHIYTKYDNYSSKGQSALLQDVKTTLQKTYSTSDLKGDGQVIGINFTDGINFEIVPSFINKDDSYTYPDTNNGGTWKITDPRKEISAMDFRNSVTNKNLKRLCRMARAWKAKCNVPMSGILIDTLAYRFINEWAFKDKSYLFYDYMSRDFFKFLKDIDKTKTYWLAPGSNRYVWKDGNFQTKASTAYNLSLEAIEHETKNRPYSAKQKWREIYGTKFPN

SEQ ID NO: 5205 - protein, 292 aa, Bacillus sp.
MSVSTNFSTFCSNLRMDSDTVTKIQDRYKKITKRINIDYWGSTSETSHSLYVGSYGRGTEIWTSDIDMIVQLPYEIYKKYDDYSSNGQSALLQNVKAVLQKTYSTSHLKGDGQVIGINFTDKINFEIVPAFINNDDSYTYPDTNNGGSWKTTDPRKEISAMDSRNNATNKNLKRLCRMARAWKGNCNVPMSGILIDTLAYKFINDWAHKDKSYLYYDFMSRDFFEYLKNIDKTKLYWLAPGSNRYVWKNGNFQTKASTAYNLALEAIEHETNGRSYSSKQKWREIYGSKFPS

SEQ ID NO: 5206 - protein, 292 aa, Bacillus thuringiensis
MAVSDYFSSFCSNLRMSNDTVNTIQYRYKQITKRVNLAYWNTSSETSHSLYVGSYGRGTEIWTSDIDIIVQLPYEIYNQYNSYKGNGQSALLQDVKKNLQITYSTSRLKGDGQVIGIDFSDGINFEIVPAFINNDGSYTYPDTNNGGSWRTTDPRSEINAMDARNNATNKNLKRLCRMARAWKEKNSVPISGILIDTLAYKFINDWHYKDKSFFYYDFMSRDFFGYLKNIDKEKLYWLAPGSNRYVYKNANFQTKASKAYDLSLEAIDLEQRNHYHTSKQKWREIYGTRFPY

SEQ ID NO: 5207 - protein, 292 aa, Bacillus cereus
MSVSNYFSSFCSNLRMSNDTVNTIQYRYKQITKRINLAYWNTSSETSHSLYVGSYGRGTEIWTSDIDIIVQLPYEIYNQYNSYKGNGQSALLQDVKKNLQITYSTSHLKGDGQVIGINFSDGINFEIVPAFINNDGSYTYPDTNNGGSWRTTDPRSEINAMDARNNTTNKNLKRLCRMARAWKEKNSVSISGILLDTLAYKFINDWHYKDKSFFYYDFMSRDFFGYLKNIDKEKKYWLAPGSNRYVYKNTNFQTKASKAYDLSLEAIDLEQRTHYHTSKQKWREIYGTRFPY

SEQ ID NO: 5208 - protein, 292 aa, Bacillus cereus
MSVSNYFSSFCSNLRMSNDTVNTIQYRYKQITKRINLAYWNTSSETSHSLYVGSYGRGTEIWTSDIDIIVQLPYEIYNQYNSYKGNGQSALLQDVKKNLQITYSTSHLKGDGQVIGINFSDGINFEIVPAFINNDGSYTYPDTNNGGSWRTTDPRSEINAMDARNNTTNKNLKRLCRMARAWKEKNSVSISGILLDTLAYKFINDWHYKDKSFFYYDFMSRDFFGYLKNIDKEKKYWLAPGSNRYVYKNANFQTKASKAYDLSLEAIDLEQRTHYHTSKQKWREIYGTRFPY

SEQ ID NO: 5209 - protein, 292 aa, Bacillus cereus
MSVSDYFSTFCSNLRMNNATISTIQYRYKQITKRINTEYWDNASETSNSLYVGSYGRGTEIWTSDIDMIVQLPDRIFRQFNSYQVNGQSALLQDIKNKLQKTYSVSHLKGDGQVIGIEFSDGINFEIVPAFINNDGSYKYPDTNEGGSWRTTDPRREISAINTRNSVTNKNLKRLCRMARAWKSTNNIPMSGILIDTLVYKFIDNWPHKDKSFLYYDFMSRDFFEFLKNIDKNQLYWLAPGSNRYVWKYGNFQNKAFIAYNLSLEAIEHETNNRPYSAKQKWREIYGTKFSN

SEQ ID NO: 5210 - protein, 292 aa, Bacillus cereus
MSVRDQFSAFCSNLRMKDTTVSTIQSRYKQITKRINIEYWGNTSDTSHSLYVGSYGRGTEIWTSDIDMIVQLPDSVYQQFNSYQVKGQTALLQDVKGKLQNTYSVSRIKGDGQVIGINFSDGISFEIVPAFINADGSYKYPDTNGGGSWRTTDPRSEISAINNRNNATNKNLKRLCRMARAWKSTNNVSISGILIDTLAYKFIDNWPHKDKSFLYYDFMSRDFFEFLKNIDRDQLYWLAPGSNRYVRKDENFQTKAAKAYNLSLEAISLASKNYPYSSTNKWREIYGSKFPY

SEQ ID NO: 5211 - protein, 291 aa, Trichococcus pasteurii
MSVYSNFSSFCSNLDMSSNTVSNIQRRYRQITKRINTNYRNSSSETAYSLYVGSYGRDTEIWTSDIDILVHLPNEIYHKFNAYASNGQSALLQDVKTVLQKTYSSSHIKGDGQVIGINFTDGINFEIVPAFLNTSDRFTYPDSNNGGSWKVTDPKKETSAINEKNSVTNGNLKRLCRMMRSWKGKCDVPISGILIDTLAYNFISTWPHRDKSYTYYDYMSRDFFLYLKNIDKANLYWSAPGSGTLIYNSENFQAKAAVAYNNALLAIDYENKNMPALAKSKWREIYGSKFY

SEQ ID NO: 5212 - protein, 293 aa, Unknown
  Description of Unknown: Enterococcaceae sequence
MGVSENFSSFCNNLRMSETTVSNVQYRYKQITKRINSDFWNSSSDSLHSLYVGSYGRGTAIHVSDIDIIVRLPVEKYHQYSKYIGNGQSVLLQEVKASLKQTYSTSHVKADGQVIGIDFKDGVSFEIVPAFQNTDNSSYTYPDSNSGGSWKVTYPREEIAAMNELNRLTNKNLKRLCRMARAWKDKNSVPISGILIDTLAYKFIKDWTFRDKSYLYYDFMSRDFFEYLKNLSTTIEFWYAPGSNRRVYKLKNFQMKAKQSYELALVAIDYEESNMPLSAKSKWRDIYGSKFPS

SEQ ID NO: 5213 - protein, 291 aa, Vitreoscilla sp.
MSFHLNFKELCTSLRMSNTTVETIRTRCNTITKRINSDYWSIDSDSKNRLYVGSYGRGTEIWVSDIDLLVILPNSFYHRFNDYTNNGQSALLNHVKDTLRKTYSTSFIKGDGQVVGIKFSDGIEFEVVPAFSVTDGSFLYPDTNNGGSWKVTNPRAEIKAMNELNVITKKNLKNFCRMIRAWKETNNVQISGILLDTLAYKFLENWKYKDKGYVYYDWMTRDFFNYLMNQDINKEYWLAPGSNRRVYKTGNFQNKAQKAFNLAVSAIQDEEKYPALAKSNWRAIYGTKFPN

SEQ ID NO: 5214 - protein, 297 aa, Mycoplasma canis
MNRIFKIFHDNIYMNKDVREKIQLRREEITKIIDNEYYEFELNSAISFFSGSYGRNTEIKSSDIDLIVILPNSVKERFDKRIGNIQSQFLTEVKEKIVKKFPRSEISSDGQVIVINFSDNIKFEVVPCFKNEFGDFLYYANTNYGGKWETMVPKKEIDAFNKGHKESNFIIKKFCRMIRSWKESNNVPIKGELIDAMVFDFFENYKGLKLEPFSCFDEYTKDFFEYIYKNIDYKSWFVPGSYRILKVENKELLKKKIYQAFIYAKKAISLPVILTNSYYSREYFWREIYGERFWKVK

SEQ ID NO: 5215 - protein, 297 aa, Mycoplasma canis
MKGIFKIFHDNIYMNKDVREKIQLRREEITKIIDNEYYEFELSSAISFFSGSYGRNTEIKSSDIDLIVILPNSVKERFDKRIGNIQSQFLTEVKEKIVKKFPRSEISSDGQVIVINFSDNIKFEVVPCFKDEFGDFLYYANTNDGGKWETMVPKKEIDAFNKGHKDSNFIIKKFCRMIRSWKESNNVSIKGELIDAMVFDFFENYKGLKSEPFNCFDEYTKEFFEYIYKNIDYKNWFVPGSYRILKVENKEFLKRKIYQAFIYAEKAISLPVILTNNYYSREYFWREIYGERFWKVT

SEQ ID NO: 5216 - protein, 298 aa, Mycoplasma canis
MNGIFKIFHDNIYMNKDVREKIQLRREEITKIIDNEYYEIELNSAISFFSGSYGRNTEIKSSDIDLIVILPNSVKKRFDKRIGNIQSQFLTEVKEKIVKKFPRSEISSDGQVIVIDFSDSFKFEVVPCFKDEFGDFLYYANTNDGGKWETMVPKKEIDAFNKGHEKSNFIIKKFCRMIRSWKESNNVPIKGELIDAMVFDFFENYKGLKLEPFNCFDEYTKDFFEYIYKNIDYKSWFVPGSYRILKVENKEFLKRKIYQAFIYAEKAISLPGVLTKSYYYSREYFWREIYGERFWKVK

SEQ ID NO: 5217 - protein, 298 aa, Mycoplasma canis
MNGIFKIFHDNIYMNKDVREKIQLRREEITKIIDNEYYEFELNSAISFFSGSYGRNTEIKSSDIDLIVILPNSVKKRFDKRIGNIQSQFLTEVKEKIVKKFPRSEISSDGQVIVIDFSDSIKFEVVPCFKDEFGDFLYYANTNDGGKWETMVPKKEIDAFNKGHENSNFIIKKFCRMIRSWKESNNVPIKGELIDAMVFDFFENYKGLKSEPFNCFDEYTKDFFEYIYKNIDYKSWFVPGSYRILKVENKEFLKRKIYQAFIYAEKAISLPVILTKSYYYSREYFWREIYGERFWKVK

SEQ ID NO: 5218 - protein, 293 aa, Staphylococcus saprophyticus
MSVGDWFRTFHNNVYMDSSTVDTVARRYRTITRKVNSEYWFSESETNNSLYVGSYGRATEIYTSDIDIIVSLPWSVKERFDKRIGNIQSQLLTEIKDKLSQTYPSSDLSSDGQVIVISFSDGVRYEIVPAFKYSDGRFCYPDTHNDGSWKVMNPKEEMNSFNLRHRVHNYTMKKFCRMIRSWREANNITISGELIDSIVYDFYSNNSYTNKDPFIYFDWLTRDFFKYLSVNTHKKWYTPGTYRTLEIKYPHITEDKAEEAYNKSLEAIKDEVQYPNLAKKTWREIYGNKFSRR

SEQ ID NO: 5219 - protein, 449 aa, Lactobacillus sakei
MKEFDAKKHFLKFIRNLKTSDEQEEIILKRVAKITKVINLEYWEIHSESKNSTLVGSYGRGTAINLSDVDLLIKLPENQKQRFTTYLNNGQSALLQDIKSKLKEVYPTSQIKGDGQIVSIKFSDGIGFEILPAFPILGEDGYEFPDTHNKGSWKKTNPDRDQQLLTAKNKQYKGIVKKFAKMLRAWKNNNNVKISGITIDVLVYNFVDTWNIDSIESCEFDEMSRDFFKWLYNFTECQNVITSLDNSYNISLDESINSKANTAWNRAQKAIKEYANKSTAENEWIKIYGKKFPIYETQKGNETKNIVINSISNRKKRKPIGNAKDTEEFLEDKDWAISEHIKIVTINAELEMNGFRKGSIRNFLKIPIKTNSKINFFVSPHRNITWYWKIRNVGETANRKDNIRGQILKGTNQHTEPINFKGTHYVEAYGLSEKTVEYFGKIEVPLEDI

SEQ ID NO: 5220 - protein, 449 aa, Lactobacillus sakei
MKEFDAKKHFLKFIRNLKTSDEQEEIILKRVAKITKVINLEYWEIHSESRNSTLVGSYGRGTAINLSDVDLLIKLPENQKQRFTTYLNNGQSALLQDIKSKLKEVYPTSQIKGDGQIVSIKFSDGIGFEILPAFPILGEDGYEFPDTHNKGSWKKTNPDRDQQLLTAKNKQYKGIVKKFAKMLRAWKNNNNVKISGITIDVLVYNFVDTWNIDSIESCEFDEMSRDFFKWLYNFTECQNVITSLDNSYNISLDESINSKASTAWNRAQKAIKEYANKSTAENEWIKIYGKKFPIYETQKGNETKNIVINSISNRKKRKPIGNAKDTEEFLEDKDWAISEHIKIVTINAELEMNGFRKGSIRNFLKIPIKTNSKINFFVSPHRNITWYWKIRNVGETANRKDNIRGQILKGTNQHTEPINFKGTHYVEAYGLSEKTVEYFGKIEVPLEDI

SEQ ID NO: 5221 - protein, 427 aa, Lactobacillus sakei
MKEFDAKKHFLKFIRNLKTSDEQEEIILKRVAKITKVINLEYWEIHSESKNSTLVGSYGRGTAINLSDVDLLIKLPENQKQRFTTYLNNGQSALLQDIKSKLKEVYPTSQIKGDGQIVSIKFSDGIGFEILPAFPILGEDGYEFPDTHNKGSWKKTNPDRDQQLLTAKNKQYKGIVKKFAKMLRAWKNNNNVKISGITIDVLVYNFVDTWNIDSIESCEFDEMSRDFFKWLYNFTECQNVITSLDNSYNISLDESINSKANTAWNRAQKAIKEYANKSTAENEWIKIYGKKFPIYETQKGNETKNIVINSISNRKKRKPIGNAKDTEEFLEDKDWAISEHIKIVTINAELEMNGFRKGSIRNFLKIPIKTNSKINFFVSPHRNITWYWKIRNVGETANRKDNIRGQILKGTNQHTEPINFKGTHYID

SEQ ID NO: 5222 - protein, 450 aa, Unknown
  Description of Unknown: Lactobacillus sequence
MKKFNAREHFSDFNRNLRTSDDQEETILKRVARITKIINSAYWNGEESRNSMLVGSYGRGTAISLSDVDLLVKLPNNQKRRFDEYLHNGQSALLQDVKSKLKETYALSEIKGDGQIVSIAFSDGIGFEILPAFSLLLGTGYEYPDTHNDGSWKKTDPARDQMLLADKNKKYGGIVKQFAKMLRAWRNTNNVELSGIAIDVLVYKFIDAWRIGYLDSSGFDDMSRDFFEWLSEIVEHREGLLSLDQNYTISLDSSVGSKACTALNRAKKAIQERFDEESAENEWAKIYGGRFPIYQTSQKNEFDNNEIENMSTKSTRVPIGTARDTEEFWEDKEWTISKYVKLIKINANLEMNGFRRRFISRLPKIPIKKNSKITFSVEPITGITWYWKVRNVGETANQRNLIRGQITKGTNETVEPIKFRGNHYVEVYGLSKNTVQYFGRIEVPLEADFK

SEQ ID NO: 5223 - protein, 446 aa, Streptococcus parasanguinis
MLEFDVIEHFKTFEKNLRTSDDDVKTISERVKVITKIINKSYWNMDSEVSHSILVGSYGRGTAIHLSDIDLLVELPENQKDRFGKYSGNGQSALLQELKSKLLKHYSNSIVKGDGQIVSIEFSDGIRFEVLPAFKISGTDKYEYPNANDGGSWEETDPKLEQYKLTDQNKQYNYAVKKFCRMLRAWNDANDVRLHGIAIDSLSYKFFETWDESKTGYVYFDRMSRDFFRYVIKFIENNNILLSLDGSYCIEVDTAIKRKAESALRNCEAAIVFCRDNQKSEESWSKVFGKKFPKLLSGKNFQTDRVSISNRSTREPIGTAIDTEQFADEMGWDIAIEKTIEIQSSLEINGFRKGSISHKFRIPIKPNSKITFSVKDTPGIYWYWKVRNVGAIANSRNAIRGQIVKRTYKIVEPINFKGNHYVEVYGVHQGRVKIYGKIDVPLEDFL

SEQ ID NO: 5224 - protein, 446 aa, Streptococcus pseudopneumoniae
MLEFDVIEHFKAFEKNLRTSEDDVNTISNRVKVITKIINKAYWNINSEVLHSILVGSYGRGTAIHLSDIDLLVELPENQKDRFGKYSGNGQSALLQDLKSKLLKHYSNSIIKGDGQIVSIEFSDGIRFEVLPAFKLSGTDKYEYPNANDGGSWEETDPKLEQYKLTDQNKQYNYAVKKFCRMLRAWNDANDVGLHGIAIDSLSYKFFETWDESKTGYVYFDWMSRDFFRYVINFIENNNILLSLDGSYSIEIDTAIKHKAESALRNCEAAIVFCRDNQKSEEYWSKVFGKNFPKLLSGKAFQTDRVSISNRSTREPIGTAIDTEQFADEMGWDIAIEKTIEIQSSLEINGFRKGSISHKFRIPIKPNSKIIFSVKDTPGIYWYWKVRNVGAIANSRNAIRGQIVKRTYKIVEPINFKGNHYVEVYGVHQGRVKIYGKIDVPLEDFL

SEQ ID NO: 5225 - protein, 461 aa, Oenococcus oeni
MVETFNTNKHFATFLKNLKVSSDVAENIMNRTHTITHIINKQYWKSESDKNHSLLVGSYGCGSAIVVSDIDLLVELPQDQKEKFDAHQNNGESALLQDVKSKLLEHYPDSDIKADGQIVSISFSDHIRFEILPAFKENSSDAYSFPNTHNSGSWDRTDPEAEARILTVANKKYSLLVKKMAKMMRAWNSENNVGLHGITIDSLIYTFFNNQSICFEGFDILSKDLFDWLENYLLTQSSVVALDDSYNIEIKDPESVRSKAHTAKKRCDCAIGSKDDQAAAESIWQQIFGDRFPIFASAEESSDKENNFDITPSVRSKRVDIGSAADTEEFPDEKWHINIRHWIVIDAEVETNGFRKGSILDFIKKYSRIPIKPRSKIFFSIHPSSTMGIVLDIEWFWKIRNVGATAIRKNCIRGQIKKYGTKHTEPIEFEGPHYVEVYGVSHGVVIAFGRAEVPLGTERIV

SEQ ID NO: 5226 - protein, 461 aa, Oenococcus oeni
MVETFNTNKHFATFLKNLKVSSDVAENIMNRTHTITHIINKQYWKSESDKNHSLLVGSYGCGSAIVVSDIDLLVELPQDQKEKFDAHQNNGESALLQDVKSKLLEHYPDSDIKADGQIVSISFSDHIRFEILPAFKENSSDAYSFPNTHNSGSWDRTDPEAEARILTEANKKYSLLVKKMAKMMRAWNSENNVGLHGITIDSLIYTFFNNQSICFEGFDILSKDLFDWLENYLLTQSSVVALDDSYNIEIKDPESVRSKAHTAKKRCDCAIGSKDDQAAAESIWQQIFGDRFPIFASAEESSDKENNFDITPSVRSKRVDIGSAADTEEFPDEKWHINIRHWIVIDAEVETNGFRKGSILDFIKKYSRIPIKPRSKIFFSIHPSSTMGIVLDIEWFWKIRNVGATAIRKNCIRGQIKKYGTKHTEPIEFEGPHYVEVYGVSHGVVIAFGRAEVPLGTERIV

SEQ ID NO: 5227 - protein, 456 aa, Oenococcus oeni
MVETFNTNKHFATFLKNLKVSSDVAENIMNRTHTITHIINKQYWKSESDKNHSLLVGSYGRGSAIVVSDIDLLVELPQDQKEKFDAHQNNGESALLQDVKSKLLGHYPDSDIKADGQIVSISFSDHIRFEILPAFKENSSDAYSFPNTHNSGSWDRTDPEAEARILTEANKKYSLLVKKMAKMMRAWNSENNVGLHGITIDSLIYTFFNNQSICFEGFDILSKDLFDWLENYLLTKSSVVALDDSYNIEIKDPESVRSKAHTAKKRCDCAIGSKDDQAAAESIWQQIFGDRFPIFASAEESSDKENNFDITPSVRSKRVDIGSAADTEEFPDEKWHINIRHWIVIDAEVETNGFRKGSILDFIKKYSRIPIKPRSKIFFSIHPSSTMGIVLDIEWFWKIRNVGATAIRKNCIRGQIKKYGTKHTEPIEFEGPHYVEVYGVSHGVVIVLHLEELRFH

SEQ ID NO: 5228 - protein, 451 aa, Lactobacillus plantarum
MVFDIGNNFSKLNKALRTQEKVETSIRNRSEKITEIINEVYWTSISKSKHSLFVGSYGRGTAIKVSDVDLLVVLPDRENERFEQYQDNGQSALLQDVKDKLKHHYSRSTIKGDGQIVSINFHDGISFEILPAFKKESHGYRYSDTHNGGTWKYTNPEEDQKILTCTNKEYNLMVKRTARIIRSWRSTNDVKISGIEVDSVLNTFFLEKILNTVSFSDLDKVINDFFKWLLNKLENKVILYSLDRSFPLELNSDIKSKLKTAVKRADKALNFQEQGKYSEAEDEWIKIFGDDFPHLYMENKNIHYNSSTNKSLIALSTRQNRSGIGTAKDTEKFADEEWKISPNCKNVEIKAELSMKGFRPKDLTFLDKFKIRRDAKIIFSIKSVEKVKWYWKIRNVGHAAIEKDDIRGNIVKGDLIRKETINFSGPHYVEVYGIVDNVVCYAGHINVPLHS

SEQ ID NO: 5229 - protein, 450 aa, Leuconostoc citreum
MVKFDVASHFKDFETSLRTSDEHVQSINKRVKKITKAINTSYWDNESDTQHSMLVGSYGRGTAIDISDVDLLVELPASQKERFSNYLSNGQSALLNDIKAKLKQEYPTSNIKADGQIVSIKFTDGIGFEILPAFPLYDGYEYPDTNNGGRWKTTNPELDQKNLKLRNKEFDGSLKRFARMLRAWKDKNNVSLSGIAIDALVYNFFSTWKNDQTSYSYFDWLSRDFFQWLYHFIDSRQKLISLDTFFEIELDLEVGSKSKTAWKRSLKAIENQMEESVAEEEWTKIYGSHFPVHAPKTDNAVRNVVAKQTISSKETRAFIGNAIDTEEFYQDKGWKLSQSLKYIDIHVQFEGKGFRRASMNKPSKIPIGLITKLYFSVQHVSGVTWYWKVRNVGDQANSRNQIRGQIKLGSENNVEATSFKGNHYVEVYGVQGTTISHFGKIDVPLGNDEV

SEQ ID NO: 5230 - protein, 450 aa, Leuconostoc lactis
MVKFDVASHFKDFETSLRTSDEHVQSINKRVKKITKAINTSYWDNESDTQHSMLVGSYGRGTAIDISDVDLLVELPASQKERFSNYLSNGQSALLNDIKAKLKQEYPTSNIKADGQIVSIKFTDGIGFEILPAFPLYDGYEYPDTNNGGRWKTTNPELDQKNLKLRNKEFDGSLKRFARMLRAWKDKNNVSLSGIAIDALVYNFFSTWKNDQTSYSYFDWLSRDFFEWLYHFIDSRQKLISLDTFFEIELDLEVGSKSKTAWKRSLKAIENQMEESVAEEEWTKIYGSHFPVHAPKTDNAVRNVVAKQTISSKETRAFIGNAIDTEEFYQDKGWKLSQSLKYIDIHVQFEGKGFRRASMNKPSKIPIGLITKLYFSVQHVSGVTWYWKVRNVGDQANSRNQIRGQIKLGSENNVEATSFKGNHYVEVYGVQGTTISHFGKIDVPLGNDEV

SEQ ID NO: 5231 - protein, 450 aa, Leuconostoc citreum
MVKFDVARHFKDFETSLRTSDEHVQIIDRRVKKITKAINTSYWDNESDNQHSMLVGSYGRGTAIDISDVDLLVELPISQKERFSNYLSNGQSALLNDIKAKLQKEYPTSNIKADGQIVCIKFTDGIGFEILPAFPLYDGYEYPDTNNGGHWKTTNPELDQKNLKLRNKEFNGSLKRFARMLRAWKDKNSVSLSGIAIDALVYNFFSTWKNDQTSYIYFDWLSRDFFEWLHHFIDSRQKLISLDTFFEIELDMEVGSKSKTAWKRSLKAIENEMDESIAEEEWIKIYGSHFPVHTLETNNAVRNVVPKQTMSSKETRAFIGNATDTEEFYQDKGWKLSQSLKYIDIHVQFEGKGFRQVSMNKPSKIPIGLITKLYFSVQRVSGVTWYWKVRNVGDQANSRNQIRGQIKLGSENNVEPTSFKGNHYVEVYGVQGATITHFGKRDVPLENSEV

SEQ ID NO: 5232 - protein, 296 aa, Slackia heliotrinireducens
MATYPIAKQFERFCGNLAISCDTLAVISYRYHSITKRLNADFWDSSSDEAHGRYVGSYGRGTRIDGSDVDILFRFPYNMYVKYDAYASNGQSALLQAAKMSIATTYPSTRLKGDGQIVAVDFSDGINFEVLPAFECEDGSYLFPDSNGGGRWRACDPVAEINELNSMDEACNGNLKRLCKMARAWREANSVSISGIAIDVFAYNFMKHYSHRDDGYIFYDRLTRDFFAYVANLDATQSTWKVFGSGRYVTTSGYFRNKAAAARNKAIEAIKDQDNGYMHATNDAWKEIYGSRFPRL

SEQ ID NO: 5233 - protein, 296 aa, Bifidobacterium bifidum
MGVSSTFESFCSSLRMDTDTVATIRRRYHSIVGLINEAYWNSSSESLHGLYVGSYGRGTEIATSDIDILVELPHETFRQYDRYTYNGQSALLQDVKSVIQTRYSTSHLRGDGQVIVIDWTDGITFEIVPAFSQVLNGGYWYPNTHDGGSWATTNPKSESNSLKGLSLFFGNRPKHLCRMTRAWRDANNIDIHGIAIDSLVFNFFQETVSYNQYRGYGNYGDLVKDFFSFVVNCGSKPLTALGNKYVVPIPDNLAEKAEEAYEHALEAMYDVAHDYWMLAEDEWKEVFGDRFTVRLS

SEQ ID NO: 5234 - protein, 305 aa, Propionimicrobium lymphophilum
MPQTARSLRMTDVHSLFRRFEANLRMSPSTVESVRLRYRTITRRLNMDFWGINSDTQHSRYAGSYGRGTAISTSDIDILVELPSDVYETYWMQTLLGSNGPSRLLQRVKESLQQTYPTTKLRGDGQVIVVEFSDGVKFEVVPVFSDGYQTLAYPDTHNGGSWQHMKPELESRAFAELSSAKPGGLKKFCRMLRAWNIKSDLQLPGQAIDAMAYEYWLTSENADKDPFLYFDWHTRDFFAYWVSEFNRNGWIEAPGSRRRIDVRFNRTELELLKIYADASRSAARTDNPDAVSTWRLIYGDKFPES

SEQ ID NO: 5235 - protein, 297 aa, Actinomyces odontolyticus
MGDENRLFRQFEANLRMTPATVSAVRNRYHAITRRINVDFWGTSSDTDHSWYAGSYGRGTAISTSDIDILVELPPGEYNDAWARSLFGGNGPSELLQKVKRSLSATYPQTKLRGDGQVVVAEFTDGVRFEIVPVFRAETPGTYRYPDTHDGGSWPTMNPRRELEVFNGLSKDHPGGLKKFCRMLRAWNKQGQYFSGQALDAMAFEYWEQSQWADNLPYLYFDWHTRDFFEYWKNEFARGGVVVAPGTRRQIDTSAPPHMVDLLALYAENAKTAIDATDTCQATEFWRLIFDDRFPKS

SEQ ID NO: 5236 - protein, 490 aa, Aquimarina spongiae
MNISTNFNVFCDRLQVSEKKKSIITLRYNAICKKLNNDFWDLNTDDGGIYVGSYGRGTASGNIDTVEMIFEMPSQLLSKYTNAKGKAQFKFLESVRKSIAAVYPNTTIENGDFGIRVRFFDGMYFFIAPVFYKDNTHHLYADLCKGGSWKEKNFRKEEEIIKIEDEEVYHNFTQLCKMAKAWKWHCEIPIEDALIDTLVCNFLNSWSYKKESYSYYDIMCKDFFEFLTNQRTFKKEWNHIGGFLVIPNALNFRYKAIMAYHKAESAIIFSRGNEPWLAAQKWKEIFGNDFPDTVAVNRQLKELKNNVLQVNKAQKAWIKKLERQRLIVIVAQILSGVMIPGALVALELFENFNIGFMLFMLATTVFIITLAYRKTNHITTILRHKVSASFTSTIQQQLQELIRDFNDQDIDVAIIKDKKQKIISKLRSLCIVTPTSSSKKYIEAIHRLREKAFLRNYTTNADVSGYFVPSWSTHQFQKEGYIQPILNYQN

SEQ ID NO: 5237 - protein, 271 aa, Bifidobacterium breve
MSSKVIRYDNIISLETRQSIAKRYHRVTRAINQEFWNSTSETAHSLYVGSYGRNTAIDTSDIDILVEIPEDEYNRYSYVKGNGQSRLLQAVKNAIQNTYSRSDVRADGQVIKIAFSDGMKFEVLPAFPQENWSGSILYKYPDSNMGGNWKTTDPRSEQRAIQEKNNSSNGLLCATCRHIRMIRDTSYSSYHLSGILIDSFVYDAIGWWHFTREDVDSSIQLKSYEQELLDHYNQISLNGLLSPTLAAPGSGTALDTSKDWNILGKILNKMT

SEQ ID NO: 5238 - protein, 271 aa, Unknown
  Description of Unknown: Bifidobacterium sequence
MSSKVIRYDNIISLETRQSIAKRYHRVTRAINQEFWNSTSETAHSLYVGSYGRNTAIDTSDIDILVEIPEDEYNRYSYVKGNGQSRLLQAVKNAIQNTYSRSDVRADGQVIKIAFSDGMKFEVLPAFPQENWSGSILYKYPDSNMGGNWKTTDPRSEQRAIQEKNNSSNGLLCATCRHIRMIRDTSYSSYHLSGILIDSFVYDAIGWWHFTREDVDSSIQLKSYEQELLDHYNQISLNGLLSPTLAAPGSGTALDTSKDWNILGKILNKMA

SEQ ID NO: 5239 - protein, 271 aa, Bifidobacterium longum
MSSKVIRYDNIISLETRQSIAKRYHRVTRAINQEFWNSTSETAHSLYVGSYGRNTAIDTSDIDILVEIPEDEYNRYSYVKGNGQSRLLQAVKNAIQNTYSRSDVRADGQVIKIAFSDGMKFEVLPAFPQENWSGSILYKYPDSNMGGNWKTTDPRSEQRAIREKNNSSNGLLCATCRHIRMIRDASYSSYHLSGILIDSFVYDAIGWWHFTREDVDSSIQLKSYEQELLDHYNQISLNGLLSPTLAAPGSGTALDTSKDWNILGKILNKMA

SEQ ID NO: 5240 - protein, 241 aa, Bifidobacterium longum
MNQEFWNSTSETAHSLYVGSYGRNTAIDTSDIDILVEIPEDEYNRYSYVKGNGQSRLLQAVKNAIQNTYSRSDVRADGQVIKIAFSDGMKFEVLPAFPQENWSGSILYKYPDSNMGGNWKTTDPRSEQRAIREKNNSSNGLLCATCRHIRMIRDTSYSSYHLSGILIDSFVYDAIGWWHFTREDDDSSIQLKSYEQELLDHYNQISLNGLLSPTLAAPGSGTALDTSKDWNILGKILNKMA

SEQ ID NO: 5241 - protein, 253 aa, Bifidobacterium longum
SIAKRYHRVTRAINQEFWNSTSETAHSLYVGSYGRNTAIDTSDIDILVEIPEDEYNRYSYVKGNGQSRLLQAVKNAIQNTYSRSDVRADGQVIKIAFSDGMKFEVLPAFPQENWSGSILYKYPDSNMGGNWKTTDPRSEQRAIREKNNSSNGLLCATCRHIRMIRDTSYSSYHLSGILIDSFVYDAIGWWHFTREDDDSSIQLKSYEQELLDHYNQISLNGLLSPTLAAPGSGTALDTSKDWNILGKILNKMA

SEQ ID NO: 5242 - protein, 271 aa, Bifidobacterium longum
MSSQVIQHNNVIPLETRQSIARRYHRVTRAINQEFWNSASETAHSLYVGSYGRNTAIDTSDIDILVEIPEDEYNRYTYTRGNGQSRLLQAVKNAIHNTYSRSDVRADGQVIKITFSDQMKFEVLPAFPQENLNGNVLYKYPDSNMGGNWKTTDPKSEQKAIREKNNSSNGLLCATCRHIRMIRDTSYTSYHLSGILIDSFVYEAIKDWSFTHENVDSSIQQKTYEQNLLDYYNQISFNGLLPPTLAAPGSRMGLDTSKDWNVLGKILNKMA

SEQ ID NO: 5243 - protein, 273 aa, Gardnerella vaginalis
MSSNVIRHDNIIPLVTRQSIASRYHTVTKAINQEFWNSTSETTHSLYVGSYGRNTAINTSDIDILVEIPEDEYNRYSYSKWNGQSRLLQAVKNAIETHYSRSDIRADGQVVKIAFSDGMKFEVLPAFPQTSLGGSVSYKYPDTNMGGNWRTTDPKSEQKAMKEKNSSSNGLLCATCKHIRTIRDDSYSSYHLSGILIDSFVYVAMEGWHFTDGDSNSSSQPRSYEQALLDYYNHIPCNEILAPSLSAPGSGMSIDTTKGWDVLGKILNKMVSE

SEQ ID NO: 5244 - protein, 273 aa, Gardnerella vaginalis
MSSNVIRHDNIIPLVTRQSIASRYHTVTKAINQEFWNSTSETTHSLYVGSYGRNTAINTSDIDILVEIPEDEYNRYSYSKWNGQSRLLQAVKNAIETSYSRSDIRADGQVVKIAFSDGMKFEVLPAFPQTSLGGSVSYKYPDTNMGGNWRTTDPKSEQKAMKEKNSSSNGLLCATCKHIRTIRDDSYSSYHLSGILIDSFVYVAMGEWHFTDGDSNSSSQPISYEQALLNYYNHIPCNGISAPSLYAPGSGMSIDTTKGWDVLGKILNKMVSE

SEQ ID NO: 5245 - protein, 273 aa, Gardnerella vaginalis
MSSNVIRHDNIIPLVTRQSIASRYHTVTKAINQEFWNSTSETTHSLYVGSYGRNTAINTSDIDILVEIPEDEYNRYSYSKWNGQSRLLQAVKNAIETHYSRSDIRADGQVVKIAFSDGMKFEVLPAFPQTSLGGSVSYKYPDTNMGGNWRTTDPKSEQKAMKEKNSSSNGLLCATCKHIRTIRDDSYSSYHLSGILIDSFVYVAIGGWYFTDGDSNSLSQQRSYEQALLNYYNHIPCNGISAPSLSAPGSGMSIDTTKGWYVLGKILNKMVSE

SEQ ID NO: 5246 - protein, 273 aa, Alloscardovia omnicolens
MSSNVIRHDNIIPLVTRQSIASRYHTVTKAINQEFWNSTSETTHSLYVGSYGRNTAINTSDIDILIEIPEDEYNRYSYSKGNGQSRLLQAVKNAIETPYSRSDIRADGQVVKIAFSDGMKFEVLPAFPQTSWGGSVSYKYPDTNMGGNWRTTDPKSEQKAMKEKNSSSNGLLCATCKHIRTIRDDSYSSYHLSGILIDSFVYVAMGGWHFTDGDSNSSSQPRSYEQALLDYYNHISCDGIFAPSLSAPGSGMSIDTTKGWYVLGKILNKMVSE

SEQ ID NO: 5247 - protein, 271 aa, Mitsuokella jalaludinii
MSSHVIRHDNIIPLVTRQSIASRYHRVTKAINQEFWNSTSETIHSLYVGSYGRNTAINTSDIDILIAIPEDEYNRYSYSKGNGQSRLLQAVKNAIETPYSRSDIRADGQVVKIAFSDGMKFEVLPAFPQTSWSGNVSYKYPDTNMGGNWRTTDPKSEQKAMKEKNSSSNGLLCATCKHIRTIRDDSYSSYHLSGILIDSFVYVAMGGWHFTDGDSNFSSQPRSYEQALLDYYNHISCNGIFAPSLSAPGSGMPIDTTKGWDVLGKILNNMA

SEQ ID NO: 5248 - protein, 271 aa, Atopobium vaginae
MSSNVIRHDNIIPLVTRQSIAGRYHTVTKAINQEFWNSTSETAHSLYVGSYGRNTAINTSDIDILVEIPEDEYNRCSYSKGNGQSRLLQAVKNAIETPYSRSDIKADGQVVKIAFSDGMKYEVLPAFPQTSWGGSVSYKYPDTNMGGNWRTTDPKSEQKAMKEKNSSSNGLLCATCKHIRTIRDDFYSSYHLSGILIDSFVYVAMGVWHFMDGDSNSSSQPISYEQALLDYYDHISCNGIFAPSLSAPGSGMSIDTTKGWDVLGKILNRMV

SEQ ID NO: 5249 - protein, 271 aa, Arcanobacterium sp.
MSSNVIRHDNIIPLVTRQSIANRYRTVTKAINQEFWNSTSETTHSLYVGSYGRNTAINISDIDILVEIPEDEYNRYSYSKGNGQSRLLQAVKNAIETPYSRSDIRADGQVVKIAFSDGMKFEVLPAFPQTSWGGSVSYKYPDTNMGGNWRTTDPKSEQKAMKEKNSSSNGLLCATCKHIRTIRDDSYSSYHLSGILIDSFVYVAMGRWYFTDGDSNSSSQPRSYEQALLDYYNHISCNGIFAPSLSAPGSEMSIDTTKGWDVLGKILNKMV

SEQ ID NO: 5250 - protein, 235 aa, Brevefilum fermentans
MESETLHSLYVGSYGRGTAIDDSDIDILIELPEVEYNRFDAVWGNGQSRLLQAVRSAILESYPRSDVRADGQVVKIAFSDGMKFEILPAFKKISYYGAWNGQYTYPDTNMGGNWLSTNPKAEQKAMQDKNKSSNGLLNDTCKHFRSIRNDYFGSYHLSGIVIDSFVYAAIQGWHWLLDSQTSSAAEGDYERALRAYLEKISPWYHLESPGSDQALNTSKSIDCLIKVVDLIAGQK

SEQ ID NO: 5251 - protein, 260 aa, Firmicutes bacterium
MRSLISTRYQTVTRAVNIEFWNSSSNSAHSLYVGSYGRGTAIDTSDIDILVEVPESNYRRYDTLKGNGQSRLLQAVRNALLSSYPRTDIRADGQVVKVQFSDGMKMEVLPAFRKPSYISTMDEYTYPDTNNGGCWLSTNPKAEQEALRSKNNMSFGLLFDTCKHIRFIRDNYFSSYHLSGIVIDSFVFNAISGWQWTQDGDSSSTVLGTYEESLLQKYYTIFPSKYYATIQAPGSNQTIDASSSVECLEKVLRFMAKQNE

SEQ ID NO: 5252 - protein, 265 aa, Veillonella parvula
MDNRVQKYGEIISQRIRSLVSLRYHTITKAINNEFWNSTSNTLHSLYVGSYGRNTAINTSDIDILVELPSDLFDRYNNLSGNSQSRLLQAARNAIINAYPRSDVRADGQVVKIAFSDGMDFEIVPAFKIWDGSYRYPDTNTGGSWKSTNPKAEQDAMAQKNKSSNGLLYDTCKHIRNIRDNSFSSYHLSGIVIDSFVYEAIGNWRWLNTGESSSQPSGTYEQVLLDYYNQHGIFGRLSINAPGSNDIVSTSSSYECLGKVLRKMV

SEQ ID NO: 5253 - protein, 266 aa, Bifidobacterium pullorum
MVDRVRKYGETISLDTRQRISKRYHAVTRAINKEFWNSISDTLHSLYVGSYGRNTAIDTSDIDILVELPGNLFDRYNNLIGNSQSRLLQAVRNAILNTYPKSDVRADGQVVKIHFSDGMYFEIVPAFKNWDGSYIYPDSNTGGSWRSTNPKAEQDAMVEKNRNSNGLLYDTCKHIRYIRDTCFSSYHLSGIVIDGFVYDAIGSWRWLNSGEASSSPSGTYEEVLLDYYVWHGIGSGASMAAPGSNDIISTASSYECLGKVLGFMAQ

SEQ ID NO: 5254 - protein, 271 aa, Clostridiales bacterium
MSNLVCKHGEIITLDIRTKISQRYHTVTKAINKEFWNSSSDTANSLYVGSYGRGTAIDTSDLDILVCLPESEYYRYDVMKGNGQSRLLQSVKNAILNVYPRSDVRADGQVVKINFSDGMKFEILPAFKVFDWFGNWTGTYKYPDTNMGGNWKSTNPKAEQDAMANKNKSSNGLLYDTCKHIRRIRDNHFSSYHLSGIVIDSFVYNAIGGWRWSEPGSTSSATIGSYEQVLIDYFNSHLFWGLPINAPGSNDLVSVDTSIECLKKVLNYMTK

SEQ ID NO: 5255 - protein, 271 aa, Candidatus Stoquefichus sp.
MSNLVCKHGEIIALDIRSKISQRYHTVTKAINKEFWNSYSDTANSLYVGSYGRGTAIDTSDLDILVCLPESEYYRYDAMKGNGQSRLLQSVKNAILNVYPRSDVRADGQVVKINFSDGMKFEILPAFKVFDWFGNWTGTYKYPDTNMGGNWKSTNPKAEQDAMASKNKSSNGLLYDTCKHIRRIRDDHFSSYHLSGIVIDSFVYNAIGGWRWSEPGSTSSATIGSYEQVLIDYFNSHLFWGLPINAPGSNDLVSTDTSIECLKKVLDYMTK

SEQ ID NO: 5256 - protein, 272 aa, Clostridium sp.
MSDLVQKRGEIISMDIRSKISLRYHTVTSAINREFWNVSSDSQNSLYVGSYGRGTAIDTSDLDILVLLPEKEYERHDALKGNGQSRLLQTVKQAILTSYPRSDVRADGQVVKITFFDGMKFEILPAFKNLDWFGNWDGSYKYPDSNMGGNWRSTNPKAEQEAIKIKNQSSNGLFCDTCKHLRFIRDNHFSSYHLSGIVIDSFVYQAIGDWRWTPPGDSSSAASGSYEKVLIDYLTSNSAWGILLLYAPGSGQKVLTESSLECLKKVMNYIAI

SEQ ID NO: 5257 - protein, 271 aa, Campylobacter fetus
MSNHIKQRGEVISQDVRSTIARRYHTVTAAINREFWNSSSDTQNSLYVGSYGRGTAIDSSDLDILMLLPESEYSRHDSLKRNGQSRLLQSVRNAIMTTYPRSDIRADGQVVKISFSDEMKFEILPAFKNTDWDGSWDGTYKYPDSNMGGNWRSTNPKAEQDAMKSKNASSNGLLFDTCKHLRFVRDNYFSSYHLSGIVIDSFVYHAIGGWRWSLLGSNSSAVSGTYEKVLLDYLNQNSVWGMLPLTAPGSGQSVSTESSLECLKKVMNYIV

SEQ ID NO: 5258 - protein, 271 aa, Campylobacter fetus
MSDHIKQRGEVISQDVRSTIARRYHTVTAAINREFWNSSSDTQNSLYVGSYGRGTAIDSSDLDILMLLPESEYSRHDSLKGNSQSRLLQAVRQAIITTYPRSDIRADGQVVKISFSDEMKFEILPAFKNTDWDGSWDGTYKYPDSNMGGNWRSTNPKAEQDAMKSKNASSNGLLFDTCKHLRFVRDNYFSSYHLSGIVIDSFVYHAMGEWRWSLLGSNSSAVSGTYENVLLDYLKQNSVWGMLPLTAPGSGQSVSTESSLECLKKVMNYIV

SEQ ID NO: 5259 - protein, 273 aa, Youngiibacter fragilis
MSYSVTKHGEVISREIISTVKTRYETVTRSINREFWNLQSDTSHSMLVGSFGRGTAIDTSDIDVLVELPKSEYDRYDIVKGNGQSRLLQAVRSAIQTAYPRSDVRADGQVVKINFSDGVRFEVLPAFQSVSYWGQSDPTYTYPDTNMGGNWKSTNPKAEQNAMIIKNNSSNGLLFDTCKHFRRVRDNHFSSYHLSGIVIDSFVYAAMGNWQWTREGGSSSAAQGDYERVLSDYLNQNSSYWLPLMISAPGSNQTVDTASSIECLKKVVSYIAD

SEQ ID NO: 5260 - protein, 272 aa, Lachnoclostridium sp.
MSFLIQRHSGVITLETRKIISSRYKTVTKAINKEFWNTLNDTQNSIYVGSYGRRTAINTSDIDILVLLPESEYQRFDALKGNGQSRLLQVVKNAIMNSYPRSDVRADGQVVKISFTDGMKFEILPAFQNKDWWGNWDGTYKYPDSNMGGNWCSTNPKAEQEAMKLKNNSSNGLLVDTCRHLRYVRDNYFSSYHLSGIVIDSFVYAAMGNWQWTRPGSTSSAPKGNYENVLLDYLRQNSFWGNLILNAPGSNQSVSTQNSLECLEKVIKFIAQ

SEQ ID NO: 5261 - protein, 269 aa, Clostridium bolteae
MNTLSLYVQRNEEVISADSRSLISKRYCTVTSAMNREFWNITSDRQNSIYVGSYGRGTAIDTSDIDILMSLPESYYNQFNSVYGNGQSRLLQVVRQAILVRYPRSEVRADGQVVKINFSDGMFFEILPAFKNWDGSYRYPDTNMGGNWRSTNPKAEQDAMKNKNISSNGLLFDTCKHLRYVRDNYFRSYHLSGIVIDSFVYQAIGNWRWLSSGESSTSAAGTYERILLDYYNQHFMWGAMPLSAPGSNQQVSTDNSRDCLGKVLRYIAG

SEQ ID NO: 5262 - protein, 269 aa, Clostridium saccharolyticum
MNTLSLYVQRNGEVISADSRSLISKRYCTVTSAMNREFWNITSDRQNSIYVGSYGRGTAIDTSDIDILMSLPESYYNQFNSVYGNGQSRLLQAVRQAILVPYPRSEVRADGQVVKINFSDGMFFEILPAFRNWDGSYRYPDTNMGGNWRSTNPKAEQDAMKNKNISSNGLLFDTCKHLRYVRDNYFRSYHLSGIVIDSFVYQAIGNWRWLSSGESSTSAAGTYERILLDCYNQHFMWGAMPLSAPGSNQQVSTDNSRDCLGKVLRYIAD

SEQ ID NO: 5263 - protein, 272 aa, Unknown
  Description of Unknown: unclassified Clostridiales sequence
MSSHVCKHQEIIPQAIRETISMRYHVVTRAINREFWGIDSELEHSLYVGSYGRGTAVNTSDLDILVELPQNRYMQYDVVKGNGQSRLLQAVRLAILNTYPRSDVRADGQVVIISFSDGMKFEILPAFKNLNWIGQWDGTYIYPDTNMGGNWLPTNPKAEQEAMYAKNRQSNGLLYDTCKHIRSVRDSNYKSYHLSGIVIDSFVFSTIGSWKWVPDGETSTSAWGEYENHLLKSLENYLQRGIYHLYAPGSNQVLSWRDSTECLWKVLNYMVN

SEQ ID NO: 5264 - protein, 272 aa, Clostridium sp.
MSSHVCKHQEIIPQAIRETISMRYHVVTRAINREFWGIDSELEHSLYVGSYGRGTAVNTSDLDILVELPQNRYMQYDVVKGNGQSRLLQAVRLAILNIYPRSDVRADGQVVIISFSDGMKFEILPAFKNLNWIGQWDGTYIYPDTNMGGNWLPTNPKAEQEAMYVKNKQSNGLLYDTCKHIRSVRDSNYKSYHLSGIVIDSFVFSTIGNWKWVSDGETSTSAWGEYENHLLKSLENHLQRGIYHLYAPGSNQVLRWRDSTECLWKVLNYMVN

SEQ ID NO: 5265 - protein, 272 aa, Oribacterium sp.
MSLYVPTDGYVIPAATRSLISDRYHTLTKAINRELWNQTSDSAHSFYVGSYGRGTAINTSDLDILVEVPSNFYVQYSYTTYNPQSRLLQVVKNALLTSWPKSDIRGDGQVVVVDFSDGMKFEVLPAIHQTDPWGRVTYKYPDTHMGGNWKSTNPKAEQDAMREKNRTSNGLLFDTCKHIRFIRDNNYSSYHLSGIVIDSFVYVAMGNWRHFNSGEGGVAPAGSYEEVLLKYWNDATWNGRYAFQLKAPGSGMDVDTSGDVECLGKVLKKMVD

SEQ ID NO: 5266 - protein, 269 aa, Listeria innocua
MLVTNSYVTPLEARQTIARRYRIVTKAINVEFWNSISETAHSFYVGSYGRGTAISTSDIDILVEIPNSEYDKFNSSTGNGQSRLLQSIRKSLQVAYPQSDIRADGQVVKINFHDGIKFEILPAFQNIDYWGKNQGYIYPDSNMGGNWKATNPKNEQEAMKIKNGPTYSNGLLYATCRHFRYVRDTYFSSYHLSGIVIDSFVYNAMGNWRYTESGSSSNASMGAYENILLEYFNNNTIWGLSLNSPGSNQTVGTTNSITCLEKVIKKIAT

SEQ ID NO: 5267 - protein, 271 aa, Unknown
  Description of Unknown: Listeria sequence
MSILVTNSYVTPLEARQTIARRYRIVTKAINVEFWNSISETAHSFYVGSYGRGTAISTSDIDILVEIPNSEYDKFNSSTGNGQSRLLQSIRKSLQVAYPQSDIRADGQVVKINFHDGIKFEILPAFQNIDYWGKNQGYIYPDSNMGGNWKATNPKNEQEAMKIKNGPTYSNGLLYATCRHFRYVRDTYFSSYHLSGIVIDSFVYNAMGNWRYTESGSSSNASMGAYENILLEYFNNNTIWGLSLNSPGSNQTVGTTNSITCLEKVIKKIAT

SEQ ID NO: 5268 - protein, 269 aa, Listeria monocytogenes
MLVTNSYVTPLEARQTIARRYRIVTKAINVEFWNSISETAHSFYVGSYGRGTAISTSDIDILVEIPNSEYDKFNSSTGNGQSRLLQSIRKSLQVAYPQSDIRADGQVVKINFHDGIKFEILPAFQNIDYWGKNQGYIYPDSNMGGNWKATNPKNEQEAMKIKNGPTYSNGLLYATCRHFRYVRDTYFSSYHLSGIVIDSFVYNAMGNWRYTESGSSSNASMGAYENILLEYFNNNTIWGLSLNSPGSNQTVSTTNSITCLEKVIKKIAT

SEQ ID NO: 5269 - protein, 270 aa, Clostridium innocuum
MDNLVSKHSDIIPSEIRKTISRRYKTVTKAINQEFWNSSSDTAHSFYVGSYGRGTAVSTSDIDILVEMPKETYIRYDSIQGNGQSRLLQVVKSAIQNAYPRSDVRADGQVIKINFADDIYFEVLPAFLSTDWYYKETYTYPDTNMGGNWKSTNPKAEQEAMKKKNDSSNGLLQATCRHFRYIRDRYYSSYHLSGIVIDSFVYVAMGNWKYLEPGESGTASAGDYERLLKDYLDRNTIWGNLNLTAPGSGQSVDTASSIECLEKVIDKILS

SEQ ID NO: 5270 - protein, 274 aa, Lactococcus lactis
MNYSVARHSGAITLDTRQTISKRYRIVTRAINREFWQSESDTLHSFYVGSYGRRTAINTSDIDILVELPISEYNRFQTISGNGPSRLLQAVRTAIKKSYPMSDVRADGQIIKINFHDGIQFELLPAFKEENYWTKETSYIYPNSNMGGSWQSTNPKAEQEAMKSKNSQSQSNGLLIATCRHLRYIRDTYYKSYKLSGIVIDSFVYAAMNNWRYVEKGTSISNSESYEQILLNYYNNKVMYGVNFLTLHAPGSGQLVDTTDSFECLGKVLNKINS

SEQ ID NO: 5271 - protein, 270 aa, Ndongobacter massiliensis
MSYTVTKSAGVIPQETRSLISRRYKSITSAINRDFWSITSDTSNSFYVGSYGRNTAISTSDIDILTVLPNSDFDSYNNLKGNAQSRLLQAVRNAILSSYPRSDIRADGQVVKIAFSDGMYFEILPAFQNKDWFGNWSSTYTYPNSNMGGNWKSTNPKAEQEAIAQKNRNSNGLLVDTCRHLRVVRDTCFKSYHLSGIVIDTFVYDAIEGWHWLELGEESTPNIISYEQVLMNYFNDNLTYISELRAPGSGDSVSLDKSKECLGKVLRFIV

SEQ ID NO: 5272 - protein, 271 aa, Bifidobacterium longum
MNFYVQKHAGVINQETRGLIAKRYRTVTKAINREFYNSYSEVEHSLYVGSYGRYTAVDTSDIDIMVILPREEYEHYDSYRGNGQSRLLQSVRNAIKQAYSMSDVRADGQVVKIAFSDEMKFEILPAFVSMDWGGNTIYEYPDSNQGGNWLSSNPKAEQEAIKQKNRSSNGLLVDTCRHMRVVRDSCFKSYHLSGIVIDSFVYSAIKDWRWCNPGVPSSSPKGSYEEIILRYWEDSIQFSPNSLTAPGSGDSVNVQKSNECLGKVLRYMAGK

SEQ ID NO: 5273 - protein, 271 aa, Bifidobacterium longum
MNFYVQKHAGVINQETRGLIAKRYRTVTKAINREFYNSYSEVEHSLYVGSYGRYTAVDTSDIDIMVILPREEYEHYDSYRGNGQSRLLQSVRNAIKQAYSMSDVRADGQVVKIAFSDEMKFEILPAFVSMDWGGNTIYEYPDSNQGGNWLSSNPKAEQEAIKQKNRSSNGLLVDTCRHMRVVRDSCFKSYHLSGIIIDSFVYSAIKDWRWCNPGVPSSSPKGSYEEIILRYWEDSIQFSPNSLTAPGSGDSVNVQKSNECLGKVLRYMAGK

SEQ ID NO: 5274 - protein, 271 aa, Bifidobacterium breve
MTFYVQKHTGVINQETRGLIAKRYRTVTRAINREFYDSYSEVEHSLYVGSYGRCTAVDTSDIDIMVILPREEYDHFDSYRGNGQSRLLQSVRTAIKQSYSTSDVRADGQVVKIAFSDEMKFEILPAFASVDWAGNTVYDYPDANQGGNWLSSNPKAEQEAMRQKNKLSNGLLVDTCRHMRVVRDSCFKSYHLSGIVIDSFVYSAIKDWHWCNPGVPSSSPKGSYEETILRYWEDFIQFSPNSLTAPGSRDSVNVQKSNECLGKVLRYMAGK

SEQ ID NO: 5275 - protein, 271 aa, Unknown
  Description of Unknown: Bifidobacterium sequence
MTFYVQRHTGVINQETRGLIAKRYRTVTRAINREFYDSYSEVEHSLYVGSYGRCTAVDTSDIDIMVILPREEYDHFDSYRGNGQSRLLQSVRTAIKQSYSTSDVRADGQVVKIAFSDEMKFEILPAFASVDWAGNTVYDYPDANQGGNWLSSNPKAEQEAMRQKNKLSNGLLVDTCRHMRVVRDSCFKSYHLSGIVIDSFVYSAIKDWHWCNPGVPSSSPKGSYEETILRYWEDFIQFSPNSLTAPGSRDSVNVQKSNECLGKVLRYMAGK

SEQ ID NO: 5276 - protein, 271 aa, Bifidobacterium longum
MTFYVQRHTGVINQETRGLIAKRYRTATRAINREFYDSYSEVEHSLYVGSYGRCTAVDTSDIDIMVILPREEYDHFDSYRGNGQSRLLQSVRTAIKQSYSTSDVRADGQVVKIAFSDEMKFEILPAFASVDWAGNTVYDYPDANQGGNWLSSNPKAEQEAMRQKNKLSNGLLVDTCRHMRVVRDSCFKSYHLSGIVIDSFVYSAIKDWHWCNPGVPSSSPKGSYEETILRYWEDFIQFSPNSLTAPRSRDSVNVQKSNECLGKVLRYMAGK

SEQ ID NO: 5277 - protein, 271 aa, Bifidobacterium longum
MTFYVQKHTGVINQETRGLIAKRYRTVTRAINREFYDSYSEVEHSLYVGSYGRCTAVDTSDIDIMVILPREEYDHFDSYRGNGQSRLLQSVRTAIKQSYSTSDVRADGQVVKIAFSDDMKFEILPAFASVDWAGNTVYDYPDTNQGGNWLSSNPKAEQEAIRQKNKLSNGLLVDTCRHMRVVRDSCFKSYHLSGIVIDSFVYSAIKDWHWCNPGVPSSSPKGSYEETILRYWEDFIQFSPNSLTAPGSSDSVNVQKSNECLGKVLRYMAGK

SEQ ID NO: 5278 - protein, 240 aa, Selenomonas sp.
MFWESDSETTHSRYVGSYGRGTAIQSSDLDILLELPPEEYHRFDKTKWNGQSRLLQAVKQSIDKHYSLSDIRADGQVVKINFSDGMKFELLPAFKEQDCFGDFTGTYTYPDSNMGGYWRSADPITEQQAMNVKNGDANTRGLLVDTCKHIRHIRDTFFKSYHLSGIVIDSFVYDAIGDWHWVREGETSQCPQGSYEQRLLNHYNTIQRQIPCLSAPGSAAIIDASNSMACLGKVLHKIAD

SEQ ID NO: 5279 - protein, 271 aa, Selenomonas artemidis
MPIYVTKHKIEQEWRSTISSRYKAVTKAFNSVFWESDSETAHSRYVGSYGRGTAIQSSDLDILLELPPEEYHRFDKTKWNGQSRLLQAVKQSIDKHYSLSDIRADGQVVKINFSDGMKFELLPAFKEQDCFGDFTGTYTYPDSNMGGYWRSADPITEQQAMNVKNGDANTRGLLVDTCKHIRHIRDTFFKSYHLSGIVIDSFVYDAIGDWHWVREGETSQCPQGSYEQRLLNHYNTIQRQIPCLSAPGSAAIIDASNSMECLGKVLHKIAD

SEQ ID NO: 5280 - protein, 271 aa, Selenomonas sp.
MPIYVTKHKIEQEWRSTISSRYKAVTKAFNSVFWESDSETTHSRYVGSYGRGTAIQSSDLDILLELPPEEYHRFDKTKWNGQSRLLQAVKQSIDKHYSLSDIRADGQVVKINFSDGMKFELLPAFKEQDCFGDFTGTYTYPDSNMGGYWRSADPITEQQAMNVKNGDANTRGLLVDTCKHIRHIRDTFFKSYHLSGIVIDSFVYDAIGDWHWVREGETSQCPQGSYEQRLLNHYNTIQRQIPCLSAPGSAAIIDASNSMACLGKVLHKIAD

SEQ ID NO: 5281 - protein, 271 aa, Selenomonas sp.
MPIHVTKHKIDQEWRSTISSRYKAVTKAFNSVFWESDSETAHSRYVGSYGRGTAIQSSDLDILLELPPEEYFRFDKTKWNGQSRLLQAVKQSIEKHYSLSDIRADGQVVKINFSDGMKFELLPAFEEQDCFGDFIRTYKYPDSNMGGRWKSANPIAEQQAMSLKNDDLHTRGLLIDTCKHIRSIRDTFFKSYHLSGIVIDAFVYDAIGDWHWMSEGETSQYPQGSYEQRLLNHYNTIQRQITCLSAPGSVASIDASSSMECLGKVLHKIAD

SEQ ID NO: 5282 - protein, 271 aa, Selenomonas infelix
MPIHVTKHKIDQEWRSTISSRYKAVTKAFNRVFWESDSETAHSRYVGSYGRGTAIQSSDLDILLELPPEEYFRFDKTKWNGQSRLLQAVKQSIEKHYSLSDIRADGQVVKINFSDGMKFELLPAFEEQDCFGDFIRTYKYPDSNMGGRWKSANPIAEQQAMSLKNDDLHTRGLLIDTCKHIRSIRDTFFKSYHLSGIVIDAFVYDAIGDWHWMREGETSQYPQGSYEQRLLNHYNTIQRQIPCLSAPGSVAIIDASSSMECLGKVLHKIAD

SEQ ID NO: 5283 - protein, 279 aa, Bacteroides stercoris
MYFCVRNKINMDTVRKRGEIISIEQRSLVSQRYRRITRAVNSEFWGSTSETAHSLYVGSYGRGTAIDTSDIDILVELPRDEYNKYDALRGNGQSRLLQALKNAILQTYPNSDIHGDGQVVVINFSDGIKFEVLPAFRQLDWWGNWNGKYDYPDSNMGGNWLTTNPKSEQQAMKEKNVASNGLLFDTCKHMREIRDNYFRSYHLPGIVIDSFVYHNIADWHWLREGEQSSNQPIGTYEKRLYDSCPVWSFNLTAPGSNMPVDTYKYIDVLIKVLKYMTEE

SEQ ID NO: 5284 - protein, 269 aa, Bacteroides sp.
MDTVRKRGEIISIEQRSLVSQRYRRITRAVNSEFWGSSSETAHSLYVGSYGRDTAIDTSDIDILVELPRDEYNKYDALRGNGQSRLLQALKNAILQTYPNSDIHGDGQVVVINFSDGIKFEVLPAFRQLDWWGNWNGKYDYPDSNMGGNWLTTNPKSEQQAMKEKNVASNGLLFDTCKHMREIRDNYFRSYHLPGIVIDSFVYHNIADWHWLREGEQSSNQPIGTYEKRLYDSCPVWSFNLTAPGSNMPVDTYKYIDVLIKVLKYMTEE

SEQ ID NO: 5285 - protein, 269 aa, Unknown
  Description of Unknown: Bacteroidales sequence
MDTVRKRGEIISIEQRSLVSQRYRRITRAVNSEFWGSTSETAHSLYVGSYGRGTAIDTSDIDILVELPRDEYNKYDALRGNGQSRLLQALKNAILQTYPNSDIHGDGQVVVINFSDGIKFEVLPAFRQLDWWGNWNGKYDYPDSNMGGNWLTTNPKSEQQAMKEKNVASNGLLFDTCKHMREIRDNYFRSYHLPGIVIDSFVYHNIADWHWLREGEQSSNQPIGTYEKRLYDSCPVWSFNLTAPGSNMPVDTYKYIDVLIKVLKYMTEE

SEQ ID NO: 5286 - protein, 269 aa, Bacteroides fragilis
MDTVRKRGEIISIEQRSLVSQRYRRITRAVNSEFWGSTSETAHSLYVGSYGRGTAIDTSDIDILVELPRDEYNKYDALRGNGQSRLLQALKNAILQTYPNSDIHGDGQVVVINFSDGIKFEVLPAFRQLDWWGNWNGKYDYPDSNMGGNWLTTNPKSEQQAMKEKNVASNGLLFDTCKHIREIRDNYFRSYHLPGIVIDSFVYHNIADWHWLREGEQSSNQPIGTYEKRLYDSCPVWSFNLTAPGSNMPVDTYKYIDVLIKVLKYMTEE

SEQ ID NO: 5287 - protein, 269 aa, Unknown
  Description of Unknown: Bacteroidales sequence
MDTVRKRGEIISIEQRSLVSQRYRRITRAVNSEFWGSTSETAHSLYVGSYGRGTAIDTSDIDILVELPRDEYNKYDTLRGNGQSRLLQALKNAILQTYPNSDIHGDGQVVVINFSDGIKFEVLPAFRQLDWWGNWNGKYDYPDSNMGGNWLTTNPKSEQQAMKEKNVASNGLLFDTCKHMREIRDNYFRSYHLPGIVIDSFVYHNIADWHWLREGEQSSNQPIGTYEKRLYDSCPVWSFNLTAPGSNMPVDTYKYIDVLIKVLKYMTEE

SEQ ID NO: 5288 - protein, 272 aa, Bacteroides fragilis
MDTVRKRGEIISIEQRSLVSQRYRRITRAVNSEFWGSTSETAHSLYVGSYGRGTAIGTSDIDILVELPREEYNKYDALRGNGQSRLLQALKNAILQTYPRSDIHGDGQVVVINFTDGMKFEVLPAFCQLDWLGNWNGKYDYPDSNMGGNWLTTDPKIEQQAMKERNVASNGLLFDTCKHIREIRDNYFSIYHLPGIVIDSFVYHHIADWHWLREGEQSSNQPRGTYEKRLYDSCPVWSFNLTAPRSNMPVDTYKCIDVLIKVLKYMSEDNVI

SEQ ID NO: 5289 - protein, 269 aa, Unknown
  Description of Unknown: Muribaculum sequence
MDTVKKRGEIISADQRLLVSQRYKRITRAVNSEFWNSDSETTHSLYVGSYGRGTAIDTSDIDMLVELPRREYERYDILKGNGQSRLLQALKNAILKTYPRSDIHGDGQVVVINFTDGIRFEILPAFRQEDWLGNWNGKYDYPDSNMGGNWLTTDPKIEQQAMRERNAASNGLLFDTCKHMREIRDNHFSSYHLPGIVIDSFVYHYIADWHWTREWEQRSDYPTGTYEKRLYNSCPIWNFNLTAPGSEMPVETSGYIDVLRKVLKYMSEE

SEQ ID NO: 5290 - protein, 260 aa, Prevotella enoeca
MISAERRSLVSQRYKRITRAVNLEFWGNDSVSNHSLYVGSYGRGTAIDTSDIDMLVELPKDEYERFDALKGNGQSRLLQTVKNVILTTYPRSNVRGDGQVVVVDFSDGIKFEILPAFRQIDWIGNWNGQYTYPDSNMGGNWLTTNPKAEQQAMRKKNIESNGLLYDTCKHMREIRDNYFPSYHLPGIVIDSFAYHYISDWHWLREGEQSSNQPKGTYEKKLYAACPSWGIFLTAPGSGMSVNTTKYLDVLNKVLSYMANE

SEQ ID NO: 5291 - protein, 228 aa, Aeriscardovia aeriphila
MYVGSYGRGTAISTSDIDILLELPKNEYYHYSSLTGNGQSRLLQTVKKSVLSRYPRTEVHGDGQVVVVVFSDGMRFELLPAFETSSGEYEYPDTHMGGNWKSTNPKAEQEALKRKDVESNGLLVDTCRQIRFLRDTYFTNEHLPGILIDAFVYDSIANWHWGSGNGTSHQSEYSSGHPYEESLLKKFRIATAWGGVPQWRAPGSGMRIDNSASICNSLGKILKKMAEE

SEQ ID NO: 5292 - protein, 272 aa, Firmicutes bacterium
MSSPVIKNAHIIDSDTRSHISSRYKRITKAINQTFWNSSSETAHSFYVGSYGRGTAINTSDLDVLIELPDDEFSHFSSIYGNGQSRLLQSVKNALLLTYPNTNIKGDGQVVVVQFTDGMKFEILPAFRNNTIWGWDGTYKYPDTHMGGNWMTTNPKAEQEAMKEKNSSSNGLLFDACKHVRHVRDNNFSSYHLSGILVDAFLYDAIGGWHFLTEGEQHSGGTTTFEESLLKYYYDISLNGYITPSLNAPGSGMKVDASKGWEIIGKILRYMA

SEQ ID NO: 5293 - protein, 231 aa, Butyrivibrio sp.
MDHSIYVGSYGRGTAINTSDLDVLIQLPDSEFNRFSSMYGNGQSRLLQAVKNAILDTYPNTDIKGDGQVVVVSFTDGMRFEILPAFKVQNYWGYDETYRYPDTHMGGNWMTTNPKAEQNAMKQKNSSTNGLLYETCKHIRYIRGTKYSSYHLSGILIDSFVYEAMGGWHFTRDGEEHVPSQKTYEETLLQHYNDISMYGMFTPRIIAPGSGLPVDSTKGWDVLGKVLNYMV

SEQ ID NO: 5294 - protein, 272 aa, Butyrivibrio sp.
MSSHVTKGQHTIDEGTRGQISSRYHRITKAVNQAFWGSNSDVDHSIYVGSYGRGTAINTSDLDVLIQLPDSEFNRFSSMYGNGQSRLLQAVKNAILDTYPNTDIKGDGQVVVVSFTDGMRFEILPAFKVQNYWGYDETYRYPDTHMGGNWMTTNPKAEQNAMKQKNSSTNGLLYETCKHIRYIRGTKYSSYHLSGILIDSFVYEAMGGWHFTRDGEEHVPSQKTYEETLLQHYNDISMYGMFTPRIIAPGSGLPVDSTKGWDVLGKVLNYMV

SEQ ID NO: 5295 - protein, 275 aa, Pseudobutyrivibrio sp.
MKISSRVIKGQYTIDEGTRGQISSRYHRITKAVNQAFWGSNSDVDHSIYVGSYGRGTAINTSDLDVLIQLPNSEYERFSSMYGNGQSRLLQAVKNAVRDTYPNTDIRGDGQVVVVRFTDGMKFEILPAFKVQNGWNYDETYRYPDTHMGGNWMTTKPKAEQNAMKQKNSCTNGLLFDTCKHIRYIRDTKYSSYHLSGILIDSFVYEAMGGWHFTRDGEGNVPSQMTYEEMLLKHYNEISMYGIFAPGLTAPGSGLQVDSTKGWDILGKVLNYMAN

SEQ ID NO: 5296 - protein, 273 aa, Pseudobutyrivibrio sp.
MSSRVIKGQYTIDEGTRGQISSRYHRITKAVNQAFWGSNSDVDHSIYVGSYGRGTAINTSDLDVLIQLPNSEYERFSSMYGNGQSRLLQAVKNAVRDTYPNTDIRGDGQVVVVRFTDGMKFEILPAFKVQNGWNYDETYRYPDTHMGGNWMTTKPKAEQNAMKQKNSCTNGLLFDTCKHIRYIRDTKYSSYHLSGILIDSFVYEAMGGWHFTRDGEGNVPSQMTYEEMLLKHYNEISMYGIFAPGLTAPGSGLQVDSTKGWDILGKVLNYMAN

SEQ ID NO: 5297 - protein, 276 aa, Selenomonas sp.
MSSHVKRNNHPIDKDTRCLISTRYKRITKAINIEFWNTNSEIAHSRYVGSYGRGTAVSTSDLDVLMELPNNEYDHFTSLTGNGQSRLLQAVKDSILETYPTTDVKGDGQVVIVKFSDGMKFEILPTFRKIDWFGKWDGTYKYPDTHMGGNWMTTNPKAEQDAMDEKDNYDYSNGLLKDTCKHIRYIRAESFKSYHLSGILIDSFVYRAIGDWHWLRDGEGQGRSNDMCFEEVLLDCYNSYYPYASLITPKLSAPGSGMEVSGDDWDVLGKVLNKMV

SEQ ID NO: 5298 - protein, 273 aa, Butyrivibrio sp.
MSSHVIQGNHPNDKDTRTLISKRYKRITKAVNEEFWDSSSETAHSRYVGSYGRGTAINTSDLDVLIELPREEYDHFASLYGNGQSRLLQAVKDAILDTYPNTDIKGDGQVVVVNFSDDMKFEILPAFQNLNILGAWDGTYKYPDTHMGGNWMTTNPKAEQDAIDEKDDYDHANGLLTDTCKHIRYIKSEYYSSYHLSGILIDSFVYDAIGWWHWLRNDEEKSNGYGKYYEETLLDLYNSVSSYYVPTLYAPGSGMKVSCDDWDVLGKILKRMV

SEQ ID NO: 5299 - protein, 269 aa, Olsenella sp.
MDKVPRNGHVINSEKRSLISSRYKRMTAAVNREFWGTSSDTANSLYVGSYGRGTAISDSDLDILISLPRSEYERFDAYRGNGQSRLLQAIKGSIELIWSTSDIHADGQVVVVKFSDGMRFEILPAFKDAYSWTNNDTYTYADTNSGGRWLSTNPKSEQEAMREKDVCSNGLLFDTCKHVRYVHTQHFSSYHLSGILIDSFVYAAIGGWHWVDPGEGSRQEKSYESCLLDYFDTNCKYSFLTLKAPGSGQTVEIGNDGDCLRKVLNWMAS

SEQ ID NO: 5300 - protein, 271 aa, Bifidobacterium coryneforme
MSLPVTRNNHSIDKNTIGVISDRYKMVTKAMNAEFYDSSSDTMHSLYVGSYGRGTAIDTSDLDIMVILPEDEYERYERYGNNGQSRLLQSVKEALKEPYPRSDIRADGQVVKINFSDGMRFEILPAFEQALYGRTTYIYPDSNMGGNWLPTNPKVEQVAMREKDADSNHLLVDTCRHMRYVHSTFFSSYILHGIVIDTFVYEALGSWHWPSPGTQGKPGGSYKYAKDMLDYWEHTSAACPVPLQAPGSNDQVEIESSNECLGKVLHKMADE

SEQ ID NO: 5301 - protein, 270 aa, Eggerthellaceae bacterium
MNRVEFATAGVDSETRSKVSGRYKRITRAVNGEFWGSRSEIEHTLQVGSYGRGTATSASDLDVLVSLPRAEYERYDAYRGNGQSRLLQAVKAAVSAIYPRTSIRADGQVVVVDFSDGVKFELLPAFARSSWSGEGFDYPDSNMGGRWLSTNPRAEQAAMKEKNDASNGLLLDTCKHMRKIHAERFSSYKLSGIVIDSFVYHAMGDWRWIGEGDGPAASPGAYENVLLDAYNTRSANGSFAFSLSSPGSNQPIDVSRSLECLGKVLRVMAE

SEQ ID NO: 5302 - protein, 285 aa, Enterococcus faecium
MEEKLIKKDEIIMGLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5303 - protein, 273 aa, Enterococcus faecium
MGLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5304 - protein, 273 aa, Enterococcus faecium
MGLLVPRANTYTIPLTKRQLIAKRYQRITRAINREFWNSVSDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5305 - protein, 273 aa, Enterococcus faecium
MGLLVPRANTYTIPLTKRQLIAERYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5306 - protein, 273 aa, Unknown
  Description of Unknown: Enterococcus sequence
MGLLVPRANTYTIPLTKRQLIAKRYQRITRAINREFWNSESDTAHSLYVGSYGRGTAISISDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5307 - protein, 270 aa, Enterococcus faecium
MGLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKK

SEQ ID NO: 5308 - protein, 256 aa, Enterococcus faecium
RQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYWGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5309 - protein, 220 aa, Enterococcus faecium
GLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATYKHFRHVRDTEFTSYHLSGIVIDSFVYEAMGNWKFVENNSGGQN

SEQ ID NO: 5310 - protein, 218 aa, Enterococcus faecium
MVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATYKHFRHVRDTEFTSYHLSGIVIDSFVYEAMGNWKFVENNSGGQN

SEQ ID NO: 5311 - protein, 238 aa, Enterococcus faecium
FWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATCKHFRHVRDTEFTSYHLSGIVIDSFVYEAMGNWKFVENNSGGQNISSVSYETALLEYYNSHKVMGGLNLYSPGSNQFVNSDSSIICLEKVLKKIAL

SEQ ID NO: 5312 - protein, 232 aa, Enterococcus faecium
  MOD_RES (195)..(195): Any amino acid
MGLLVPRANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATCKHFRHVRDTEFTSYHLXGIVIDSFVYEAMGNWKFVENNSGGQNISSVSYETALL

SEQ ID NO: 5313 - protein, 269 aa, Enterococcus hirae
MGLLIQKSNFYSIPLYKRQRIATRYHRITKAINRAFWNSESDSAHSLYVGSYGRGTAISTSDIDILVELPMSELDRFKSYSSNGPSRLLQVIRKTILEILPSSDIRADGQIVKINFHDGIKFEIVPAFNDKDYFGNSKGFIYPDSNMGGNWKATNPKKEQEAMKLKNIQSNNLLYDTCKHFRHVRDTEFKSYHLSGIVIDSFVYEAIGSWKYVDNNNGQVVNSGEYEKTLLNYFNSHNIFGFLNLYSHGSNQFVDTENSIVCLEKVLKK

SEQ ID NO: 5314 - protein, 190 aa, Enterococcus faecium
ANTYTIPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATCKHFRHVRDTEFTSYHLSGI

SEQ ID NO: 5315 - protein, 185 aa, Enterococcus faecium
MPLTKRQLIAKRYQRITRAINREFWNSESDTAHSLYVGSYGRGTAISTSDIDIIVELPMAEFDRFKNYLSNGPSKLLQVIKNAFQEILPNSDIRADGQVVKINFHDGIKFEIVPAFNEKDYLGESKGFIYPDSNMGGNWKATNPKKEQEAMKLKNTKSNNLLYATCKHFRHVRDTEFTSYHLSGI

SEQ ID NO: 5316 - protein, 150 aa, Pediococcus acidilactici
MGLLVQKASFYAISLGKRQLIAKRYHRITKAINREFWDSESDSAHSLYVGSYGRGTAINTSDIDILVELPMSELDRFKFYSSNGPSRLLQVIRKTIINVLPNSDIRTDGQIVKVNFCDGIKFEIVPAFKEKDYLGTSTGFIYPDSNMGGN

SEQ ID NO: 5317 - protein, 271 aa, Lactobacillus rhamnosus
MASYVEMHKNIIPRSVREIVTRRYHTITKAGNRAFWDSESEVAHSLYVGSYGRSTAVKTGDIDILYSLPQSEFDRFQKVNGNGQSRLLQALRGAIKSSYPTSDIRADGQVVKIQFSDGMKFEVLPAFHKVDYFGEEQSGFRYPDSNMGGNWKSTDPKAEQEAMKEKNKESNGLLQATCRHLRLVRNEHFSTMKLAGIVIDSFAYSAIGSWKFLAQGQNSDASEGDYEMVLNKYFNEHYLWSGNLYAPGSNQVVDLDASRDTLAKVLAYLVK

SEQ ID NO: 5318 - protein, 269 aa, Lactobacillus sp.
MSSYVQKHSNIISREVRNIVTQRYQNVTSASNRTFWQSNSNTNHSIYVGSYGRGTAVKTGDIDILCSLPKSEFDHFNNSNGNGQSRLLQSLRNSILVSYPHSDIRADGQVVKISFSDGMKFEILPAFHQLDPWGLELSSFRYPDSNMGGKWKSTDPKAEQKAVHIKNKESNGLYQATCRHLRIIRNDHFKSFHLSGIVIDSFVYSAMQGWRFTPTGEQSKSSLGDYENVLLKYFYDHYSDALYSPGSQQKVDLNSNSEALEKVLNYLVK

SEQ ID NO: 5319 - protein, 266 aa, Streptococcus castoreus
MTNRVKRYDGVITLEQRQAISKRYKRITKVINSEFWNLSSDTKNSFYVGSYGRGTAISTSDIDILVNLPKNLFDNYNNLSGNGQSRLLQAIRTALIQTYPNSDIRADGQIVKIRFSDGILFEILPAFQKLDGTYIYPNTNSGGNWLSTNPKAEQETMSEKNISSNGLLIATCQHMRYIRDNHFKSYKLSGIVIDSFVFHAMKNWKFVSEGESSSAPGSYEQILLDYFNENAFLWDIISLRAPGSQDEVETKKSIDCLEKVLKYMVG

SEQ ID NO: 5320 - protein, 261 aa, Lactobacillus animalis
MRYDNIIPKDERDNISSRYRQITKAVNREFWGTASETSNSIYVGSYGRNTAISTSDIDILVCLPFSKFDSYNRLTGNGQSKLLQAVRQALKVSYPNSDIRADGQIVKINFYDGISFEILPAFKNLDGSYTHADSNMGGRWRSTNPKEEQSAIREKNNLSNGLLVATCRHIRYVRDNFYKSYKLPGIVIDSFAYYAISDWKFVNFGEKAAEPGTYEKRLLNYFEENRYYWERVGLYAPGSNEYIDVANSMESLEKVLRYMNG

SEQ ID NO: 5321 - protein, 261 aa, Gardnerella vaginalis
MKRYNEVISVEQREKISKRYHKITSAINEEFWKINSSIDHSLYVGSYGRNTAICTSDIDILLCLPSAIFDRFNALTGNSQSRLLQAVKTAIKEAYPNSDIRADGQIIKIAFSDGIIFECLPAFKNTSGFFVYPDSNMGGKWLSTNPKAEQEAIRDKNKTSNGLLVSTCKHMRYIRDNFFKSYKLSGIVIDSFAYHAIENWVFTESGGSETFSYEKHLLAFYNEHYLSWLLSEMNAPGSNDKIDISGSAKCLEKVLKYMVEE

SEQ ID NO: 5322 - protein, 208 aa, Weissella koreensis
MSQLVVSYKNIIDEDKRRLISDRYHKVTKAINTAFWNINSDSKNSLYVGSYGRGTAISTSDIDILVVLPRSKYDQFNHHKGNVQSQLLQVVKNAIKTQYPRSEIRADGQIIKINFFDNIKFEILTAFSKIDVFGNTLEGYDYPNSNLGGNWESTNPKAEQEAMRDKNNKTNVLYKATCRHIRYIRDTYYSSAAIIYLESSLIVSFMML

SEQ ID NO: 5323 - protein, 271 aa, Lactobacillus plantarum
MGELVVSHKNIIDKDTRRLISDRYHRVTKAINTIFWNIDSDSKNSLYVGSYGRNTAISTSDIDILVSLPRSKYDQLNLHKGNVQSQLLQAVKSAIEIPYSRSEIRADGQVIKINFFDNVKFEILPAFRKVDLFGNLLEGYDYPNTNMGGNWEATNPKAEQDAIRDKNNNTNGLYRDTCRHIRYIRDTCFSSYHLPGIVIDSFVYDAIGNWKYVGNGESTAKKGDYEKRLLNYFNQINTLGRMNLTSPGSNQSVETINSTDCLEKVLTKIAI

SEQ ID NO: 5324 - protein, 272 aa, Mycoplasma gallinarum
MRNLIDNCSINLEKRTKISNRYKQITKAINKEFWNSLSETNNSLYVGSYGRNTAISSSDIDILVILPAKEFDWANNLKGNSQSRLLQAVKLAIKDAYSTSEIRADGQIIKINFRDGIVFEILPAFEQFDKSFVYPDTNKGGKWKITNPRKIQEAMKEKNKMSNDLLTFTCKIIRIIKDKYFQSYKLSGIVIDSFVFHSIDQWRFLPSYCVPNINFEIYINHLITIFEQNYWKWYINGLETPGSKELVDFENSSSCLGKVLQFWYDKARNHNF

SEQ ID NO: 5325 - protein, 260 aa, Staphylococcus argenteus
MHDNIINRETRERISRRYKKITKAINYEFWNINSEEKNTLYVGSYGRNTSISSSDIDVLTILPRSEFDKYNNLTGNSQSKLLQAVKKSILDVYPNSDIKADGQVIIIKFTDGIIFEILPAFKKLDGSFMYPDTNGGGFWKSTNPKSEQEELKRKNNLSNGLLIATCRHIRFIRDNYFSSYYLSGIVIDSFVYHAIGNWHYSSKISNVPHISYEQNLLDFYQSNFHFLKLMGIKAPGSNDVVSVEKSMVCLEKVLKYMVGN

SEQ ID NO: 5326 - protein, 86 aa, Cellulosilyticum lentocellum
MYVGSYGRGTAINSSDLDVLFELPQNEYNRYDLVKGNGQSRLLQAVRNAILTSYPRSEVRADGQVVKVLFSDGMKFEILPAFKNID

SEQ ID NO: 5327 - protein, 283 aa, Bacillus sp.
MNVENVLKKITPNNHNIISTRYHRIVRSINSYYWGIDSSRQNCRYVGSYGRGTAIDGFSDVDMIVVLPETYYERFRKYQHNGQSALIQNVKRALNFTYSRSFTKGDGQVIVIEFSDGIKFEIVPAFKIKDTYTYPDSNESGSWKKCNPLKEIEAVNLINKYHNGKLKNLCKLTRAWKKENNINISGILIDALAAMYMLYLKEEQKSWDYKFLFTDFLNYLGSQFQKNSWLICGSWDVIQRNNMEFEDCALQSASYCIKAMKYEFDKDYSLADTYWEKIFGNVI

SEQ ID NO: 5328 - protein, 289 aa, Unknown
  Description of Unknown: Bacillus sequence
MKVGIALNVENVLKKITPNNHNIISTRYHRIVRSINSYYWGIDSSRQNCRYVGSYGRGTAIDGFSDVDMIVVLPETYYERFRKYQHNGQSALIQNVKRALNFTYSRSFTKGDGQVIVIEFSDGIKFEIVPAFKIKDTYTYPDSNESGSWKKCNPLKEIEAVNLINKYHNGKLKNLCKLTRAWKKENNINISGILIDALAAMYMLYLKEEQKSWDYKFLFTDFLNYLGSQFQKNSWLICGSWDVIQRNNMEFEDCALQSASYCIKAMKYEFDKDYSLADTYWEKIFGNVI

SEQ ID NO: 5329 - protein, 278 aa, Bacillus licheniformis
MLKKITPNNHNIISTRYHRIVRSINSYYWGIDSSRQNCRYVGSYGRGTAIDGFSDVDMIVVLPETYYERFRKYQHNGQSALIQNVKRALNFTYSRSFTKGDGQVIVIEFSDGIKFEIVPAFKIKDTYTYPDSNESGSWKKCNPLKEIEAVNLINKYHNGKLKNLCKLTRAWKKENNINISGILIDALAAMYMLYLKEEQKSWDYKFLFTDFLNYLGSQFQKNSWLICGSWDVIQRNNMEFEDCALQSASYCIKAMKYEFDKDYSLADTYWEKIFGNVI

SEQ ID NO: 5330 - protein, 292 aa, Bacillus sp.
MKGEVGSMKFENLLESLRVDNSEIISFRYHKIVRTINQYYWRINSDSKNCRYVGSYGRGTAIKNLSDIDMLVILPKTLFTRFSDYKFNGQSSLLQNVKKALNLTYARTSTKADGQVVVVEFSDGTKFEVVPAFKEGELFFYPDSNQNGSWKKCNPIKEVEAINLINKFSDGRLKKITKLTRAWKKANDVDISGILIDCLAMEFILEKDGKYPTIEILFGEFLLYLAKQREKENWWILGSNDIINRNGMLFEEKALKGVDSLLSGVNLKLKGLTLSADEHWKNLFGKFVNGVM

SEQ ID NO: 5331 - protein, 284 aa, Bacillus kribbensis
MNLTPLLKGLRTKNHDIISYRYHRIVKTINNYYWGISSDDKNCRYVGSYGRGTAIKGFSDVDIIVKLPKNEFQRFNSYRFNGQSALLQNVKKALDFSYSRTSTKGDGQVVVVIFSDGIKFEIVPSFENDNGTLTYPDSNKSGTWLECDPAKEIKAINIVNKVFDGQVKNVCRLTRAWKVTNNVDISGALIDALATNFFLSEDRKFDSTAFAFGYFLLYLGKQNGLNHWYVPGSNNILYRENYEFEKKALKSLDDFLSAIKYQDTYNSHYFLRKLFGDFLNGVTS

SEQ ID NO: 5332 - protein, 199 aa, Acinetobacter sp.
MSETTVFNIKYRVEQITKRINLDFWGIESGIRHSLYVGSYGRGTDIHTSDIDLIIELPFEMYSRYSNYIGNGQSALIQAVKDAIKKTYSSTYVRGDGQVVKLNFTDGICFEIVPAFLNSDGINYTYPDTNNGGSWKVTKPREEKNALNQLNIGSNKNLKRLCRMARAWKDQWNVPISGILLDTLAYRFMEQWSYSRLPS

SEQ ID NO: 5333 - protein, 214 aa, Acinetobacter sp.
MSISVKFTSFCNNLRMSETTVFNIKYRVEQITKRINLDFWGIESGIRHSLYVGSYGRGTDIHTSDIDLIIELPFEMYSRYSNYIGNGQSALIQAVKDAIKKTYSSTYVRGDGQVVKLNFTDGICFEIVPAFLNSDGINYTYPDTNNGGSWKVTKPREEKNALNQLNIGSNKNLKRLCRMARAWKDQWNVPISGILLDTLAYRFMEQWSYSRLPS

SEQ ID NO: 5334 - protein, 293 aa, Acinetobacter baumannii
MSISDKFISFCNNLRMSETTVSNIKYRVEQITKRINLDFWGIESGIRHSLYVGSYGRGTDIHTSDIDLIIELPFEMYSRYSNYIGNGQSALIQAVKDSIKKTYSSTYVRGDGQVVKLNFTDGICFEIVPAFLNSDGINYTYPDTNDGGSWKVTKPREEKNAFNQLNIDSNKNLKRLCRMARAWKDQWKVPISGILLDTLAYRFMEQWAYSNHSYSFYDWMTRDFFKYLKDQNPEQYYWLAPGSKQYVWRSGIFEYKASKCYDLALKALEYEDKKMPYTANQTWREIYGNKFPA

SEQ ID NO: 5335 - protein, 293 aa, Acinetobacter sp.
MSISDKFISFCNNLRMSETTVSNIKYRVEQITKRINLDFWGIESGIRHSLYVGSYGRGTDIHTSDIDLIVELPFEMYARYSNYIGNGQSALIQAVKDSIKKTYSTTYVRGDGQVVKLNFTDGICFEIVPAFLNSDGVNYTYPDTNNGGSWKVTKPREEKNALNQLNVNSNKNLKRLCRMARAWKDQWNVPISGILLDTLVYKFMEQWSYSNHSYSFYDWMTRDFFKYLKDQNPEQYYWLAPGSKQYVWRSGNFEHKASKCYDLALKALEYEDKKMPYTANQTWREIYGNKFPA

SEQ ID NO: 5336 - protein, 290 aa, Lysinibacillus odysseyi
MGVASNFETFCKNLRMSEETVNKITYRTKRITKQLNIDFWGSTSDTDHSFYSGSYGRGTDIYTSDIDLLVRLPYSTYVKYNNYTSNGQSALLQAVKESIEKTYKSYKRGDGQVVKVDFEDNISYEIVPCFLNDDETYTYPDTNNGGSWKTTNPKAEIKAFNELNKSSNKNLKRLCRMIRAWKNKNNVQMSGYLIDTLCYRFMQNWSYSDKSYLYYDWMIRDFFDFLIEQSDKTYWYVPGSNRRIDKVHSFDYKAKQAKNIALKAIEYESNGNEYSSKREWRELFGTKFPS

SEQ ID NO: 5337 - protein, 295 aa, Faecalicatena contorta
MSDISVSQDFTEFCKNLRMNSSTVKDIQTRYHAITKRINKDFWSTESETNHSFYVGSYGRGTAIYTSDIDIVVELPWSEYTKYNAYSGNGQTALLQAVKTSLQKTYSSSNVGGDGQVVVIDFSNGIKFEIVPAFILNEDTYIYPDTHNGGSWKYMKPKEEMAVFSGRNSISNNNLKKLCRMARAWNSNMSVLMSGILIDTIAYRFMQSYEYADKSYSYFDWLSRDFFKYLYDNADKEYWIKFGDNKQHVTKKYSFKSEAKNAYDLSIAAISAANKDYSYTWHSKWREIYGTKFPL

SEQ ID NO: 5338 - protein, 292 aa, Faecalicatena contorta
MSVSQDFTEFCKNLRMNSSTVKDIQTRYHAITKRINKDFWSTESETNHSFYVGSYGRGTAIYTSDIDIVVELPWSEYTKYNAYSGNGQTALLQAVKTSLQKTYSSSNVGGDGQVVVIDFSNGIKFEIVPAFILNEDTYIYPDTHNGGSWKYMKPKEEMAVFSGRNSISNNNLKKLCRMARAWNSNMSVLMSGILIDTIAYRFMQSYEYADKSYSYFDWLSRDFFKYLYDNADKEYWIKFGDNKQHVTKKYSFKSEAKNAYDLSIAAISAANKDYSYTWHSKWREIYGTKFPL

SEQ ID NO: 5339 - protein, 291 aa, Clostridioides difficile
MSVSQDFTTLCKNLRMSDYIVKDVQTRYHAITKRINKDFWFTDSETSHSFYVGSYGRGTAIYTSDIDIVVELPWSEYTKYNNYIGNGQSALLQSVKSSLQKTYSSSNVSGDGQVVVIDFSNGIKFEIVPSFKLNDGTYVYPDTHNGGSWKYMDPKGEINCFNGRNSLSNNNLKRLCRMARAWNSNMNVFMSGILIDTIAYRFMQNYEYADKSYSYYDWLSRDFFKYLYDNADKEYWVKFGDNKHVTKKYSFKSEAKKAYELSLSAIDAYGKGYSYTWHSKWREIYGTKFPI

SEQ ID NO: 5340 - protein, 291 aa, Bacteroidetes bacterium
MSISNWFETFNKNLRMPPETVDTISYRYKRIIKQLNKDFWNSESDTLHSLYVGSYGRGTEIHTSDIDIMIQLQYETYVQYNVYTNNGQSALLQAVKTSIEKTYKPTYIRADGQVIKLDFTDGINFEIVPAFINKDNSYTFPDSNNGGSWKITNPIPEIDVMTKSNNNWNKNLKRLCRMGRAWKETWDVPIGGLLIDTLAYNFLTDYEYKDKSYSYYDYMSRDFLAFLKEQKADQQYWLAVGSNQYVYTKGNFQYKALRCYNISLEAIAKEKDYPTIAKSKWREIYGTKFPS

SEQ ID NO: 5341 - protein, 290 aa, Anditalea andensis
MSVSNWFETFNHNLRMSTQTVADITYRYKRITKQLNKDFYNSESDTYHSFYAGSYGRGTDILVSDIDMVFQLPYSEYVKYNAYFGNGQSSLLQAVKTSIEKTYKSIMKADGQVIIISFTDGVIFEIVPAFVNTDGSFTFADTNNGGSWKTTNPKPEIAEMTTKNKLWNRNLKRLCRMARAWKYKWDVPMGGLLIDTLAYSFMTDCSYKDKSYLYYDFISRDFFKFLSEQNLDQNYWRSPGARQYVWRKGKFEYKAKQCYNIALEAIAKEKYYPITAKSKWREIYGTKFPS

SEQ ID NO: 5342 - protein, 290 aa, Geofilum rhodophaeum
MSVSNWFETFNQNLRMSKETTDNISYRYKRITKQLNKDYYSSESDIYHSLYVGSYGRGTDIVVSDIDMIFQLPYSEYVKYNSYSGNGQSALLQAVKKSIEKTYKSHMKADGQVIVISFTDGIVYELVPAFINKDDSYTFADTNNGGSWKTTNPKPEIAEMTSKNKLWNKNLKRLCRMARAWKYKWDVPMGGLLIDTLAYNFMANCEYKDKSYLYYDFISRDFFKYLSEQNKEQSYWLSPGARQYVWRKGTFEYKAKQCYNLALEAIEKEKDYPNTAKSKWREIYGTKFPS

SEQ ID NO: 5343 - protein, 290 aa, Bacteroidetes bacterium
MSVATWFETFVKNLRMSSDTVDNIAYRYKRITRQLNKDFWESDSDVYHSLYVGSYGRDTDIVTSDIDMLFQLPYKIYERYNNYQGNGQSALLQAVKSSVEKTYKSYMRADGQVLVISFTDGIVFELLPAFINTNNSYTYPDTNNGGNWKNTNPRPEIKEISDKNILWNNNLKKLCRMIRAWKYKWDVPLGGLLIDTLCYNFLSQSEYKAKSYLYYDYITRDFFKYISEIDPNKEYWLSPGARQYVWKKGNFQYKAKQCYNLALEAISKETDYPFTAKTKWRDIYGTKFPS

SEQ ID NO: 5344 - protein, 293 aa, Macrococcus caseolyticus
MDTVQNFSKFNNNLRMDNDVVDTIKMRFERILKRINIEYRGIDSGKLYGMYVGSYGRGTEIWTSDIDIIVQLPYKIYVQYNNYIGNGQSALIQNVKNTLQKTYPNSHIRGDGQVVVINFGDSITFEIVPAFINKDGKSFTYPDTNNGGSWKVTKPILEIESMNIRNDFTNKNLKKLCRMMRAWKSENNVPISGMLIDTLVYHFLTNYEYSSKSYVYFDRISRDFFKYLKELDINKEYWYAPGSHEKVYKSKDFHYKATSAYNRSLEAISCQGRSHWISANLKWREIYGKKFSI

SEQ ID NO: 5345 - protein, 291 aa, Legionella pneumophila
MGIAEKFEHFCSALRMPKQTVENISYRAKRITRQINSDFRGIDSDSQYSLFVGSYGRGTEIHTSDIDIIIQLPYSTYQRYNSYQSNGQSALLQGVRDSLKKTYATTHLSGDGQVVKLAFNDDICFEIVPAFINQDGKSYTYPDTNNGGSWKTTDPKSEISEMTSANILWNKNLKRLCRMARAWKDQWDIPISGLLIDTLSYNFLRSWQYRDKSFTYYDWMTRDFFEFIKNQKSTQNYWIAPGSAQYVWRKGTFEYKALQCHNLAIEAIKYEEKNMPYTADDYWRKIYGNKF

SEQ ID NO: 5346 - protein, 293 aa, Zooshikella ganghwensis
MSISDKFSNFCTALRMSDTTVLNVCCRAKQITKRVNTDFRGIDSDTRYSLFVGSYGRGTDIHVSDIDMIVELPYSEYEKYDKYNGNGQSALIQAVKDSIKKTYSTTHVSGDGQVVKLNFKDGICYEIVPGFINKDGSSYTYPDSNNGGSWKVTKPREEISEITSTNNLWNKNLKRLCRMARAWKDKWDVPIGGLLIDTLAYNFLKQWKYKDKSYVYYDWMTRDFFEYLKNQDSNKNYWLAPGSSQYVWRKGSFEYKALRCYNIANNALQYEEEEMTYSANQKWQEIYGKKFPS

SEQ ID NO: 5347 - protein, 291 aa, Yersinia pseudotuberculosis
MSISDKFSSFCTALRMSETTVSNIRYRAKQIVKRINYDFRDIDSDNRYSLFVGSYGRGTDIHVSDIDMIVELPYSVYEKYNNYSGNGQSALIQAVKDSIKKTYSTTHVSGDGQVVKINFQDGICYEIIPGFINKDGSSYTYPDSNNGGSWKVTRPREEISEITSANNSWNKNLKRLCRMARAWKDKWNVPIGGLLIDTLAYNFLKQWEYKDKSYVYYDWMTRDFFEYLKNQDPNQNYWIAFGSSQYVWRKGSFEYKALCCYNIAKEALRYESDDMPYTANIKWREIYGSKF

SEQ ID NO: 5348 - protein, 293 aa, Candidatus Thiodiazotropha endoloripes
MSISDKFSKFCSDLRMTDDTVSNIRYRSKQITKRVNSDFRNIDSDTRYSLFVGSYGRGTDIHKSDIDMIVELPYSEYEKYNNYSGNGQSALIQAVKESIKRTYSTTHVSGDGQVVKLNFQDGICYEIVPGFINKDNTSYTYPDTNNGGSWKNTKPREEIAEITSANNLWNKNLKRLCRMARAWKDKWDVPMGGLLIDTLAYNFLKHWEHKDKSFVYYDWMTRDFFEFLKNQDPDKSYWLAPGSSQYVWRKGPFEYKALRCYNIAVEAIKYESVEMPYSANNKWREIYGTKFSG

SEQ ID NO: 5349 - protein, 293 aa, Methylobacter tundripaludum
MSVADKFSSFCTALRMSNTTVSNVSSRAKQITKRINYDFWGINSDIRYSLFVGSYGRGTDTHVSDIDMIVELPYSMYEKYHNYNGNGQSALIQAVKNSIKTAYSTTYVRGDGQVVKLNFTDGICYEIVPGFLNNDGKSYTYPDTNNGGSWQITKPRDEITEINSANSNWNKNLKRLCRMARAWKDKWDVPIGGLLIDTLAYNFLNNWEYRDKSFIYYDWMTRDFFEYLKNQDANKNYWLAPGSRQYVWRKGPFEYKALRCYNLAMEAIQFESNNMPYSANSKWQEIYGAKFPS

SEQ ID NO: 5350 - protein, 293 aa, Pseudoalteromonas sp.
MSISEKFSTFCSALRMSGDVVSNVSYRAKQITKRVNSDFRGLDSDTSYSLFVGSYGRGTDIFVSDIDMIIQLPYELYQKYSGYQTNGQSALLQAVRDSIKKTYSTTHIGGDGQVVKLNFTDGICYEIVPAFINKDGESFTYPDTNDGGKWKVTNPKAEIKEINSANNHWNKNLKRLCRMARAWKDKWDVPIGGLLIDTLAYNFLKQWEHKDKSFTYYDWMTRDFFAYLKDQDPDKNYWLAPGSSQYVWRKGKFEYKALRCYNIAVEALDYERDNMSASANLKWREIYGTKFPS

SEQ ID NO: 5351 - protein, 293 aa, Pseudoalteromonas sp.
MSISEKFSTFCSALRMSGDVVSNVSYRAKQITKRVNSDFRGLDSDTSYSLFVGSYGRGTDIFVSDIDMIIQLPYELYEKYNGYQTNGQSALLQAVRDSIKKTYSTTHIGGDGQVVKLNFTDGICYEIVPAFINKDGESFTYPDTNDGGKWKVTNPKAEIKEINSANNHWNKNLKRLCRMARAWKDKWDVPIGGLLIDTLAYNFLKQWEHKDKSFTYYDWMTRDFFAYLKDQDPDKNYWLAPGSSQYVWRKGKFEYKALRCYNIAVEALDYERDNMSASANLKWREIYGTKFPS

SEQ ID NO: 5352 - protein, 293 aa, Vibrio vulnificus
MSVSDKFSTFCTNLRMSDVVISDISYRTKQITKRINSDFRGIDSDTRYSLFVGSYGRGTDIHVSDIDLIVQLPYEEYAKYDSYTTNGQSALLQAVRNSIAKTYSSSYVSGDGQVVKLNFTDGICFEIVPAFINEDDRSFTYPDTNNGGRWRVTDPRSEIAQINESNGHWNKNLKRLCRMARAWKDNWDVPMGGLLIDTLAYNFLKQWEYRDKSFIYYDWMSRDFFHYLKNQNPDQSYWLAPGSNQYVYRKGSFEYKALRCYNIACEAIDYESRGMPYTANQKWREIYGTKFPS

SEQ ID NO: 5353 - protein, 293 aa, Shewanella sp.
MGVYDKFSNFCSNLRMSEQVVSTISYRTKQITKRVNSDFRDLNSEVQYSLFVGSYGRGTEIHTSDIDLIVQLPYSEYQKYNAYSSNGQSALLQVVRTSIANTYSTTHISGDGQVVKLNFSDGICFEIVPAFINEDLKSYTYPDTNNGGSWKVTKPRDEIKAINDANNAFNKNLKRLCRMARAWKERWQVPISGLLIDTLAYNFLKDWNHKAGSFSFYDWMSRDFFEYVKNQNSDQKYWYAPGSNQKVYRTGGFEYKALRCYNISLEAIEYESNGMPYSANQKWREIYGTKFPS

SEQ ID NO: 5354 - protein, 293 aa, Candidatus Margulisbacteria bacterium
MSIANKFRAFCSNIVITDAQISNIAYRYKRITKQLNIDFWGNDSDIYHSLYVGSYGRDTDIHVSDIDMLFHLPSWVYDQYNRYQGNGQSALLQALKESVKKTYSTSYLRADGQVVKVDFTDGICFEIVPGFINVDNVSFIYPDTNNNGSWRVTNPRAEIAAIKDANLKWNYNLKRLCRMARSWKDTWSVPIGGLLIDTLAYNFMNNWAYKDNSFTYYDWLTRDFFAYLKGQKSDQNYWLAPGSNQYVWRSGNFEYKATRCYNIAIEALSYEAQNQEWSANQKWRDIFGAKFSD

SEQ ID NO: 5355 - protein, 292 aa, Unknown
  Description of Unknown: uncultured bacterium sequence
MGIPDKFQSFCSNIQITQDVANSVSYRYKRITRQLNSDFYDLDSDTSHSLYVGSYGRNTAMNASDVDILFQLKYSDYLKYNGYVINGQSSLLQDIRTSLLKTFGTSHISGDGQVVEIDFNDNINFDIVPAFVNIDGSFTYPDSNNGGSWKTTNPKREIESIRDANIEWNSNLKRLCRMIRAWKDHWNVPIGGLLIDTLAYNFMENWKHRVNSFVYYDWLTRDFFEYLKNQNPDQNYWRAPGSGQSVARNGNFEYKALQCYNISLEALNYESNKQDYSANLKWREIYGYNFPS

SEQ ID NO: 5356 - protein, 291 aa, Deinococcus phoenicis
MGVGENFRIFCDNLIVPNQSDISYRYRRITRRLNLDFWGVDSETSHSFYVGSYGRNTAIGASDLDVLFQLPYSVYERFNGYAGNGQSALLQAIRTSIQNTYSVTSVGGDGQVVVVPFTDGVKFEILPAFINKDDSYTYPDSNGGGTWKKTDPKPEIQAIKARDALYGGNLRRLCRMMRAWKHEWQVPIKSLLIDTLAYRFIETWEHREKSYVYYDWMVRDFFLYLSNQNDTQTYWSAPGSGDPVWSIGSFQYKAKRCYNISLEAIKYDSDNMSYTARGKWREIFGSKYSSP

SEQ ID NO: 5357 - protein, 304 aa, Alphaproteobacteria bacterium
MTLLTALSPQAKSLTSNFYDFCSSISLSQDKKDSISCRYKRITKQLNKDFWDTDSELSHSLYVGSYGRGTCINKVSDIDILFQMPYSVYKQYNSHLGNGQSALLQAVKNSLTRTYSTSHLRGDGQVVQINFDDNIKFEIVPVFINKDERSFTFPDSNNGGSWKITDPKSEQNAISSIDKLCNYNLKHLCRMARSWKSQQRVPISGMLIDTLAYSFIQTWKYKDKSYTYYDWMFRDFLEFLFGLSETQEYWLAPGSKKAVYKKDNFHYKAKTSYNMSLDAIEYMRKNMEYSAIQRWKEILGNNFR

SEQ ID NO: 5358 - protein, 293 aa, Cycloclasticus sp.
MSVSENFKTFCSNLRMSDTVVSNVQYRYKRITKQLNADFRDLNSDTAYSLYVGSYGRGTAIHVSDIDMIIELPYSVYEKYDNHSGNGQTALLQAVRDSIKKTYSTTHIRGDGQVVQLNFDDGICYEIVPGFINKDKESFTYPDTNDGGSWKVTKPRAEINELKNGDALWNNNLRRLCRMARAWKDKWNVPMGGLLIDTLAYNFMKQWEYRDKSYIYYDWMSRDFFKYLKDQDSEQEYWLAVGSGQYVYRKGNFEYKALRCYNISLEAIEHQSNDKNWSANQKWREIYGTKFPD

SEQ ID NO: 5359 - protein, 293 aa, Alphaproteobacteria bacterium
MGVGEDFRSFCGNLAVTVARRSCISDRCQMITRRLNLEFWGSDSPTNHSIYAGSYGRGTATGVTSDVDMIFWLPPAIYTKYNSYLGNGQSALLQAFKNALQKTYSTTHIGADGQVVVVAFWDGITFEIVPAFEMLDSSFKYPDTNDGGTWKNTNPRPEIAEINRMDQECNGNLKNLCKMARAWKMEWGVPIGGFLIDTLAYKFIIDYAHRDKSFLYYDLVSRDFFDYLAGQSSSQNVWLSPGSNQHVVRAGLFEYKALQCKNIAIDACGYQGDKYGWTARQLWRKIYGTKYPT

SEQ ID NO: 5360 - protein, 291 aa, Candidatus Lloydbacteria bacterium
MGVGDDFKTFCGNLAVTKRSTISDRYELITRRLNLEFWDSDSRVNHSIYTGSYGRGTATGATSDVDMIFWLQYKDYLRFDGYQGNGQSAMLQEVRAAIKKTYSVTNIGADGQVVVVPFDDGITFEVVPAFVNKDESFTYPDSNNGGSWKSTNPRPEIAEMNSMDNKCNGNLKNLCKMARSWKAVWNVPISGLLIDTLAYQFIRDYEYREKSYVYYDFMSRDFFQFLRDQKEDQSYWLSPGAGQYVWRTGKFEYKATQCRNLANEACSYQGDKYGWTARQKWREIYGTHFPN

SEQ ID NO: 5361 - protein, 291 aa, Pseudoxanthomonas sp.
MGVGDDFRTFCGSLAVTQRSVISERYELITRRLNLDFYNTDSRVQHSVQVGSYGRGTATAKTSDVDMIFWLPLSQYYRFDAYSGNGQSALLQAVRASVRATYSSTSVGADGQVVSVPFHDGINFEVLPAFENSDRSFTYPDANNSGRWRVTSPRPEIEAMNLMDSLCNGNLKNLCKMARAWKHVWSVPMSGLLIDTLAYQFIKDYEYRERSFLYYDFMSRDFFEFLRSHSPLQTRWLAPGSGQHVYREGNFEYKALQVKNIAAAACAYQADTYGGVARAKWRQIYGTKFPA

SEQ ID NO: 5362 - protein, 293 aa, Moorea bouillonii
MSVANQFNTLCNNLKVPQSTRSKISNRYQGITQRLNIDFWGIKNNKKHSLYVGSYARGTAVQGFSDLDIIFILPHDLYNKYNSYQSNGQSALLQSVKKSLQFTYPTTDIGGDGQVVVIQFKDGIKFEVVPAFEWTDSSFRYPDSNNGGSWKSTNPRPEIQTIKDKNKLMNGNLINLCRMARAWKKKWNVPMGGLLIDTLCNNFLKSGKYKDKSYSYYHLMSRDFFKYLSSQKQNQKYWYAVGSKQRIYRTGNFEYKAKKCYKIALEAIKNQSSKRNYSAQKKWKKIYGTSFPG

SEQ ID NO: 5363 - protein, 298 aa, Haliscomenobacter hydrossis
MKNSTVNKTTTVETAFHQFCQNITLPAATIKKIQQRYQRIVKQLNKDFWGQPEPVAHCLYVGSYGRDTDILVSDIDVLFWLPKARLARYQDRITNGASGLLQDLKKSIKRTYTSTSLRADGQVVVAPFNDKVRFEIVPCFEQADKSFIYPDTNQGGSWHKTDPRPEIEAVNAMDKKTNGLMKNLCRMTRAWKQEWNVPISGLLIDTLVYNFLNQWKPKSGAKVRYDHACRDFFKFLSEQNQEQSYWLALGSRQHVERTGLFEHKAKRCYNLALEAIEKEKFRIAHTKWRQIYGNKFPA

SEQ ID NO: 5364 - protein, 433 aa, Campylobacter concisus
MGVANKFENLIYTLRIPDDKIAKISDRYKQITKRLNNDFWDENSEKEHSLYVGSYGRDTETKTSDIDMLFWLPYEKYSQYNSYSGNGQSALLQDVKESIRKTYSQTDIRADGQVIIIDFNDGICFEVVPCFENNDCSFEYPDTNDGGSWKTTNPRPEIQTIKDKNKEWNKNLKRLCRMARAWKDEFGVSIGGLLIDTLAHNFLENWEYKNESYSCYHWMIRDFFEYLKNQNKEQKYWHAVGSNQKIYRIGKFENKAKKAYELSLKAIEFEEEKNEEKANEKWSEIFGNIFIKEDKSVKFSNKNYRNTEEFIEDQFNIDIRYILEIDCNVTQNGFRPFKLLNMLAERKILLPKKKLEFEITKNTAVGDYDIYWKVLNRGDEAKRRDKIRGQIIKGDKTKIEHTKFKGNHLVECYIVQKNVVIARDRIDVPIIEE

SEQ ID NO: 5365 - protein, 263 aa, Unknown
  Description of Unknown: uncultured microorganism sequence
VMGLADWFSSFCSNIQVQDGGTISTRYKAITRRFNTDFWNTTSETSHSLCVGSYGRNTAIQGFSDVDMVFELPSDLYFQYDKYSGNGQSALLQAVRNSMQKTYSTSSIGADGQVVAVSFQDGITFEVVPVFNNKAGSYTYPDSNLGGSWKTTNPKPEIEAIRARNSTCNGNLVPLCRMMRSWKRKWSVPIGGLLVDTLAYQFIDGWQYKDKSYLYYDYMCRDFFKWMADQSSDQNTGRHPEVANTSMARGFSNIRRSIVTISA

SEQ ID NO: 5366 - protein, 293 aa, Nitrospira sp.
MGLADWFSGFCSNIQVQDGGTLSLRYKSITRRLNTDFWSTTSETSHSLFVGSYGRNTAIQGFSDLDMVFELPSDLYFQYDKYKGNGQSALLQAVRNSMQKTYSSSSIGGDGQVVVVAFQDGITFEVVPVFTNKAGSYTFPDSSGGGSWKTTNPRSEIEAIRTRNTACNKNLVPLCRMMRAWKKTWDVPIGGLLVDTLAYQFIEGWQYKDKSYLYYDFLCRDFFRFMADQDKEQEYWKAPGSGQYVYGKGLFQWKATRCYNISCEAIAHETATPKKEWSAKQEWREIFGASFPD

SEQ ID NO: 5367 - protein, 293 aa, Sphingopyxis sp.
MSLSNWFSDFCSNLQIQDGGTISNRYKTITRRLNTDFWNTTSDTSHSLYVGSYGRGTSTQGFSDLDMVFELPSSLYFQYDKYTGNGQSALLQAVRNSMQKTYSTSRIGGDGQIVSVSFQDGITFEIVPVFTNKSDSYTYPDSNGGGSWKTTNPRPEISAIKNRNTICNNNLIPLCRMMRAWKKKWNVPIGGLLIDTLAYQFIENYEHRDKSYIYYDFMCRDFFKWMSEQSSEQTYWKAPGSGQYVYGKGLFQYKAKQCYNIAVEAIADETATPKREWSAKYEWRRIFGTKFPD

SEQ ID NO: 5368 - protein, 170 aa, Paraglaciecola sp.
MSLSNWFSDFCSNLQIQDGGTISSRYKAITRRLNTDFWSTTSDTSHSLYVGSYGRGTSIQGFSDLDMVFELPSSLYFQYDKYTGNGQSALLQSVRNSMQKTYSTSSIGGDGQIVSVSFQDGITFEVVPVFTNKSDSYTYPDSNGGGSWKTTNPRPEISAINIINMTPILK

SEQ ID NO: 5369 - protein, 293 aa, Nitrosomonas oligotropha
MGVAEWFNSFCTNLQVQDSSTISSRYKTITRRLNTDFWNTTSDLSHSLYVGSYGRNTAIKGFSDLDMVFELPSALYHQYNAYNWNGPSALLQAVRTSLQKTYSSSDVGGDGQVVVINFQDGITFEIMPAFVNQAKTYTYPDSNKGGSWKTTNPRAEIKAIKERNMNCSGNLISLCRMTRAWRGKWEVPIGGLLIDTLAYQFIKNYEFRYKSYFYYDYMCRDFFKWMADQDKEQIFWRAPGSEQYVYGKGLFQYKAKQCHKIALDAIKYETSIPKMEWFAKQEWRSIFGTAFPD

SEQ ID NO: 5370 - protein, 291 aa, Lacunisphaera limnophila
MPLAEWFTSFCANQTVTKGDDISYRYHRITRRLNTDFWTTDSDAAHSRYVGSYGRNTAIDGFSDVDMVFELPNALYHQYNAHTGNGQAALLQAVRSSIKETYSVTSIRADGQVIVVPFDDGVNFEVVPVFVNDNDTYTFPDSNNGGSWRTTDPRREIAAIKERNDATNGNLVRLARMLRAWKKTWDVPIGGLLIDTLAYQFIENYQYRDKSYLYYDFFSRDVFDWMANQDSEQEWWRAPGSGAYVYGKGLFQYKARRACNLAKEAIAYDSAKQEWSAKQKWREIYGTSFPD

SEQ ID NO: 5371 - protein, 293 aa, Dehalogenimonas sp.
MGLAEWFSTYCSNICVQNGPTISTRYKMITQRLNLDFWSIYSEISHSLYVGSYGRNTAINGVSDIDMVFELPANVFEKYNAYISNGQSALLQAVRSSLLKTYPNSRVGGDGQVVAIDFADGITFEIVPVFTNDDGSYIFPDSNDGGKWRTTNPRAEIQAIRERNSNCNENLYRLCRMMRSWKSQWDVPIGGLLIDTFAHQFIGNWSNRDKSFYYYDFMCRDFFKWVSEQSPDQMLWRAPGSNQYVFAKGPFIKKASKCHDIALEAIEHEMATPKREWSAKQKWREIFGTEFPS

SEQ ID NO: 5372 - protein, 293 aa, Candidatus Fraserbacteria bacterium
MGLADWFQSFCANTQVQDGGTISTRYRAITRRLNTDFWNTTSDTAHSIYVGSYGRNTAIQGFSDLDMVFQLPYSLYEQYNAYVGNGQSALLQSVKSSIEKTYSTTSIRADGQVILVPFTDGITFEVVPAFINKGDSFTFPDANAGGAWRVTNPKPEIEAIRTRNLACNNNLVPLCRIMRSWKRKWDVPVGGLLIDTLAYQFIENYDYKDKSYLYYDFMSRDFFKWMSDQDENQEFWRAPGSSQHVYGKGLFQYKAKRCYNISLEAIAHETSKPKQEWSAKQKWRDVFGSEFPN

SEQ ID NO: 5373 - protein, 293 aa, Anaerolineae bacterium
MGLAEWFSTFCANIQVQDGGTISTRYKNITRRLNSDYWTTTSDTAHSLYVGSYGRNTAIQGISDLDMIFQLPYSVYEQYNNYSGNGQSALLNAVKTSIEKTYSTTSIRADGQVILVPFNDGITFEVVPAFINKDDSFTYPDSNNGGRWRTTNPKPEIEAIRSRNAVCNGNLILLCRMMRSWKNKWNVPIGGLLIDTLAYQFIESYTYRDKSYLYYDYFCRDFFKWMAEQDENQEYWKAPGSGQYVYGKGLFQYKANRCYNISLEAIAHETASPKQEWSAKQKWRDIFGNSFPD

SEQ ID NO: 5374 - protein, 293 aa, Aeromonas salmonicida
MGLADWFSTFCENLRVQDGGTISTRYKAITRRLNTDYWTTTSETAHSLYVGSYGRNTAIHGISDLDMIFQLPYEVYRQYDGHTGNGQSALLQAVKKSIEKTYATTSIRGDGQVILVPFTDGITFEVVPAFINKDDSFTYPDANNGGRWWVTNPKPEIAAIRTRNAACNGNLVPLCRMMRAWKRKWDVPIGGLLLDTLAYQFIDTWQYKDKSFLYYDYMCRDFFRFMADQDKDQEYWKAPGSGQYVYGKGMFQWKATRCYNIAVEAIGHETSNPKQEWSAKQKWRDIFGTSFPD

SEQ ID NO: 5375 - protein, 293 aa, Pseudomonas syringae
MALAEWFSTFCYNIRTQDAETIPSRYKAITRRLNTEFWNTTSDVAHGLYLGSYGRNTAIQGISDLDVLFQLPYSIYQQYNNYNGNGQSSLLQAVKKSIEKTYSTTSIRGDGQVILIPFTDGITFEVLPAFINDDDSYTYPDANGGGCWRVTNPKPEISAIRTRNAACNGNLVLLCRMMRAWKQKWDVPISGLLVDTLAYQFIDTWQHKDKSYLYYDFMCRDFFYFMSNQDSQKEYWKAPGSGQHVYGKGLFQWKATRCYNLAREAIEHEVASPKREWSAKQKWREIFGTSFPD

SEQ ID NO: 5376 - protein, 293 aa, Pseudomonas aeruginosa
MALAEWFSTFCYNIRVQDSGTIPSRYKAITRRLNTEFWNTTSDVAHGLYLGSYGRNTAIQGISDLDVLFQLPYSVYQQYNNHTGNGQSSLLQAVKRSIEKTYSTTSIRGDGQVILVQFTDGITFEVLPAFINADDSFTYPDANGGGCWRVTNPKPEISAIRTRNGVCNGNLVLLCRMMRAWKRKWQVPISGMLIDTLAYQFIDNWQYKDKSYFYYDFMCRDFFYFMSNQDSNKEYWKAPGSEQHVYGKGLFQWKATRCYNLAREAIEHELATPKREWSAKQKWREIFGTSFPD

SEQ ID NO: 5377 - protein, 293 aa, Unknown
  Description of Unknown: Pseudomonas sequence
MALAEWFSTFCYNIRVQDSGTIPSRYKAITRRLNTEFWNTTSDVAHGLYLGSYGRNTAIQGISDLDVLFQLPYSVYQQYNNYAGNGQSSLLQAVKRSIEKTYSTTSIRGDGQVILVPFTDGITFEVLPAFINDDDSFTYPDANGGGCWRVTNPKPEISAIRTRNGVCNGNLVLLCRMMRSWKRKWQVPISGMLIDTLAYQFIDNWQYKDKSYFYYGFMCRDFFYFMSNQDSSKEYWKAPGSGQHVYGKGLFQWKATRCYNLAREAIEHELATPKREWSAKQKWREIFGTSFPD

SEQ ID NO: 5378 - protein, 293 aa, Pseudomonas sp.
MALAEWFSTFCYNIRTQDGGTISSRYKNITRRLNNDYWNTSSDVAHGLYLGSYGRNTATQGFSDLDVLFELPFAVYQQYNNHIGNGQSSLLQAVKRSIEQTYPNTSIRGDGQVILIPFTDGITFEVLPAFVNTDNSYTYPDANNGGRWRVTNPKPEIAAIRARNTSSNGNLVPLCRMMRAWRKKWDVPISGLLIDTLAYQFIDTWAHKDKSYLYYDYMCRDFFHFLANQDSNKTYWTAPGSGQHVYATGLFQWKATRCYNIAREAIEHEMATPKREWSAKQKWREIFGTSFPD

SEQ ID NO: 5379 - protein, 293 aa, Actinobacteria bacterium
MGLADWFSMFCSNIQAKDGGTISTRYKNITKRLNTDFWSTDSNTSHGLYVGSYGRNTAIQGFSDLDIIFQLPYKMYEQYYNYTGNGQSALLQTVRMSISKTYSTTSIRADGQVIVVPFTDGISFEVVPAFVNTDDSFTYPNANNGGSWCVTNPKPEIKAIRDINASCNYNLVPLCRMMRAWKNRWNVPIGGLLTDTLAYQFIANWEYRDKSYFYYDYMCRDFFDFMANQDKDQAYWRAPGSGQYVYGKGLFQYKAKQCYNLAVAAIKHEQATPKQEWSAKQKWREIFGASFPD

SEQ ID NO: 5380 - protein, 293 aa, Ignavibacteria bacterium
MGLSDWFSSFCSNLTVKDEATISSRYKSITKRLNTDFWNTESDTSHSLYVGSYGRNTAIQGFSDLDMIFQLPYSVYEQYNKYIGNGQSALLQAVKTSIEKTYSTTSIRGDGQVIVVPFTDGISFEVVPAFTNTDDSYTFPDSSGGGSWKKNNPKPEIQAIRDRNNSCNGNLVRLCRMMRSWKGKWDVPIGGLLIDTLAYQFIENWEYRDKSYVYYDYMCRDFFKWMSEQDSEQEYWKAPGSGQYVYGKGLFQYKAKRCYNISLEAIEHETATPKREWSAKQKWREIFGTAYPD

SEQ ID NO: 5381 - protein, 293 aa, Deltaproteobacteria bacterium
MALADWFSTFCSNLQIRDGGTIATRSGNITRRLNTDFWFTTSDTSHSLYVGSYGRNTAISGFSDVDLIFQLPYSVYKQYNDYSGNGQSALLQAVKTSIERTYSTTNIRADGQVIQVPFTDGIVFEVVPAFDNDDGSFTFPNANDGGSWKTTNPRPEIKAIRDRNAVTNGNLVPLCRMMRDWKNKWTVPIGGLLLDTLAYQFIETWEHRDKSYVYYDYMCRDFFKWMAAQDENQEWWRAPGSGQYVWGKGLFQYKAKRCYNLSLEAIEHEMATPKREWSAKQKWREIFTTNFPD

SEQ ID NO: 5382 - protein, 294 aa, Paucibacter sp.
MALADWFRTFCTRLQIQDAGTISLRYRNITRRLNTDFWTTTSETAHSLYVGSYGRNTAIAGFSDLDMIFRLPYDVYERYNNYYGNGQSALLQSVKSSIERTYATTNIRADGQVIQVPFNDGIMFEVVPAFLNKDDSFTFPDANDGGRWRITNPRPEIQAIRDRNGVTNENLVPLCRMMRDWKSKWNVPIGGLLIDTLAYQFIENWQYRDKSYVYYDFMCRDFFKWMSDQDGTQEWWRSPGSRQYVWGKGLFQYKAKRCYNLALEAIEHEMADPKREWSAKQKWREIFTTNFPDT

SEQ ID NO: 5383 - protein, 293 aa, Alkalilimnicola ehrlichii
MAVGDWFSTFCGNIKVSNKDSISRRYKAITRRLNTDFWDTVSDTSHSLYVGSYGRNTAVGGFSDLDMLFRLPYSVYERYNNYNGNGQSALLQEVKRSIERTYATTKIRGDGQVILVPFDDGLTYEVVPAFVNKDDSFTYPDANNGGRWRTTNPKPEIEAIRTRNNQCNKNLIWLCRMMRIWKRKWDVPIGGLLIDTLAYQFIENWEYRDKSFVYYDWMCRDFFNFMANQDKTKEYWKAPGSGQYVYGKDLFQWKARRCCNIAIEACKHESADPKREWSAKQSWREIFGTKFPN

SEQ ID NO: 5384 - protein, 293 aa, Vibrio furnissii
MAVGDWFSTFCGDIKVSNKDSISRRYKAITRRLNTDFWDTVSDTSHSLYVGSYGRNTAVGGFSDLDMLFRLPYSVYERYNNYNGNGQSALLQEVKRSIERTYSTTKIRGDGQVILVPFDDGLTYEVVPAFVNEDDSFTYPDANNGGRWRTTNPKPEIEAIRARNSQCNKNLVWLCRMMRIWKRKWEVPIGGLLIDTLAYQFIENWEHRDKSFVYYDWMCRDFFNFMANQDKTKEYWKAPGSGQYVYGKDLFQWKARRCCNIAIEACKHESADPKREWSAKQSWREIFGTKFPS

SEQ ID NO: 5385 - protein, 293 aa, Salinivibrio sp.
MAVGDWFSTFCGNIKVSNKDSISRRYKAITRRLNTDFWDTVSDTSHSLYVGSYGRNTAVGGFSDLDMLFRLPYSVYERYNNYNGNGQSALLQEVKRSIERTYATTKIRGDGQVILVPFDDGLTYEVVPAFVNKDDSFTYPDANNAGRWRTTNPKPEIEAIRARNNQCNKNLIWLCRMMRIWKRKWDVPIGGLLIDTLAYQFIVSWEHRDKSFVYYDWMCRDFFNFMANQDKTKEYWKAPGSGQYVYGKDLFQWKARRCCNIAIEACNHESANPKREWSSKQSWREIFGTKFPS

SEQ ID NO: 5386 - protein, 293 aa, Marinomonas sp.
MAVGDWFSTFCGNIKVSNKDSISRRYKAITRRLNTDFWDTVSDTSHSLYVGSYGRNTAVGGFSDLDMLFRLPYSVYERYNNYNGNGQSALLQEVKRSIERTYATTKIRGDGQVILVPFDDGLTYEVVPAFVNKDDSFTYPDANNGGRWRTTNPKPEIEAIRARNKQCNKNLIWLCRMMRIWKRKWDVPVGGLLIDTLAYQFIENWEYRDKSFVYYDWMCRDFFNFMANQDKAKEYWKAPGSGQYVYGKDLFQWKARRCCNIAIEACEHESADPKREWSAKQSWREIFGTKFPS

SEQ ID NO: 5387 - protein, 293 aa, Nitrincola nitratireducens
MSVGDWFRKFCVDIKVKDKESISRRYKAITRRLNTDYWNTTSDTSHSLYVGSYGRNTAVNGFSDLDMIFQLPYSVYKKYNDYIGNGQSALLQEVKRTIEKTYSKTSIRGDGQVILVPFTDGLIYEVVPAFINDNDSYTYPDANSGGRWRVTNPRPEILAIRTRNDQCNKNLVWLCRMMRVWKNKWEVPIGGLLVDTLAYQFIETWKHRDKSFMYYDWMCRDFFDFMAKQDKEKAYWKAPGSGQSVYGKGLFQWKARRCCNIAIEACEHESANPKREWSAKQKWREVFGNQFPS

SEQ ID NO: 5388 - protein, 293 aa, Nitrosomonas halophila
MSVGDWFKTFCVNTKVKNKESISRRYKAITRRLNSDYWNTTSDTSHSLYVGSYGRNTAVNGFSDLDMIFQLPYSVYKKYNEYAGNGQSALLQEVKRSIEKTYSTTSIRGDGQVILVPFTDGLTYEVVPGFINDNDSYTYPDANSGGCWRVTNPRPEINAIRIRNDQCNKNLVWLCRMMRVWKNKWDVPIGGLLVDTLAYQFIETWEYRDKSFMHYDWMCRDFFNFMANQDKEKAYWKAPGSGQYVYGKGLFQWKARRCCNIAIEACEHESATPKREWSAKQKWREVFGNQFPS

SEQ ID NO: 5389 - protein, 293 aa, Gammaproteobacteria bacterium
MSIADWFQTFCRKLQVSNGAAISRRYQNITQRLNTDFWSTTSETAHSLYVGSYGRNTAIDGFSDLDMIFHLPSSLYEKYDKYTVNGQSALLQAVKTSIERTYSTTSIRADGQVIVVPFTDGMYFEVVPGFDNVGGTFTYPDANNGGVWRTTDPKPEIKAIRDRNGETNGNLVWLCRMARQWKQEWSVPIGGLLIDTLAYQFIESWAYKDKSFFYYDYLCRDFFAWLANQSLEQEYWRAPGSGQRVHGKGLFQHKAKRCYNLALEAIAHETAKPSREWSAKQKWREIFGTTFPD

SEQ ID NO: 5390 - protein, 293 aa, Dyella jiangningensis
MSVAIWFQTFCAALQVDAVTTITQRYGAITTRLNTDFWVTTSSTAHSLYAGSYGRNTAIRGFSDLDMVFQLPQSLYARYDGYMSNGQSALIQAVKTSIESTYSRTSVRGDGQVIQVPFTDGLTFEVVPGFQNQDGSYTYPDANDGGRWRQTDPRAEISAFRTRNTAVNGNLVPLGRMMRQWKGEWSVPISGLLIDTLAYQFIENYEHRGKSYYYYDFLCRDFFKFMSERSRTQNYWRAPGSGHQVFGGELFQYKALRCYNLALEAIGHELATPKREYSAKRKWREIFGSRFPD

SEQ ID NO: 5391 - protein, 293 aa, Unknown
  Description of Unknown: Enterobacteriaceae sequence
MGLAEWFCGFCSNLTVKDGGTISTRYRNITKRLNTDFWDSSSDTSHSLYVGSYGRNTATQGLSDLDMIFQLPYSEYQKYNSYLGNGQSALLQAVKRSIEKTYATTSIRGDGQVILVPFNDGITFEVVPAFLNVSDSYTFPDANGGGRWRITNPKPEISAMRLRNNITNNNLVQLCRMARAWKRKWDVPISGLLIDTLAYQFIENWAHRDKSYLYYDFMSRDFFKWMADQDTSKEYWKAPGSGQYVYGKGLFQYKAKRCYNISLEAIEHEMATPKREWSAKQKWREIYGSTFPD

SEQ ID NO: 5392 - protein, 293 aa, Escherichia coli
MGLAEWFCGFCSNLTVKDGGTISTRYRNITKRLNTDFWDSSSDTSHSLYVGSYGRNTATQGLSDLDMIFQLPYSEYQKYNSYLGNGQSALLQAVKRSIEKTYATTSIRGDGQVILVPFNDGITFEVVPAFLNVSDSYTFPDANGGGRWRITNPKPEISAMRLRNNITNNNLVQLCRMARAWKRKWDVPVSGLLIDTLAYQFIENWAHRDKSYLYYDFMSRDFFKWMADQDTSKEYWKAPGSGQYVYGKGLFQYKAKRCYNISLEAIEHEMATPKREWSAKQKWREIYGSTFPD

SEQ ID NO: 5393 - protein, 293 aa, Escherichia coli
MGLAEWFCGFCSNLTVKDGGTISTRYRNITKRLNTDFWDSSSDTSHSLYVGSYGRNTATQGLSDLDMIFQLPYSEYQKYNSYLGNGQSALLQAVKRSIEKTYATTSIRGDGQVILVPFNDGITFEVVPAFLNVSDSYTFPDANGGGRWRITNPKPEISAMRLRNNITNNNLVQLCRMARAWKRKWDVPISGLLIDTLAYQFIENWAHRDKSYLYYDLMSRDFFKWMADQDTSKEYWKAPGSGQYVYGKGLFQYKAKRCYNISLEAIEHEMATPKREWSAKQKWREIYGSTFPD

SEQ ID NO: 5394 - protein, 266 aa, Escherichia coli
NITKRLNTDFWDSSSDTSHSLYVGSYGRNTATQGLSDLDMIFQLPYSEYQKYNSYLGNGQSALLQAVKRSIEKTYATTSIRGDGQVILVPFNDGITFEVVPAFLNVSDSYTFPDANGGGRWRITNPKPEISAMRLRNNITNNNLVQLCRMARAWKRKWDVPISGLLIDTLAYQFIENWAHRDKSYLYYDFMSRDFFKWMADQDTSKEYWKAPGSGQYVYGKGLFQYKAKRCYNISLEAIEHEMATPKREWSAKQKWREIYGSTFPD

SEQ ID NO: 5395 - protein, 293 aa, Citrobacter braakii
MGVAEWFCGFCSNLTVKDGGTISTRYKNITKRLNTDFWDSSSDTSHSLYVGSYGRNTATQGLSDLDMIFQLPYSEYQKYNSYLGNGQSALLQAVKRSIEKTYATTSIRGDGQVILVPFNDGITFEVVPAFINVNGSYTFPDANGGGRWRITNPKPEISAMRLRNNSTNNNLVQLCRMVRAWKRKWDVPISGLLIDTLAYQFIENWAHRDKSYFYYDLMSRDFFKWMADQDTSKEYWKAPGSGQFVYGKGLFQYKAKRCYNISLEAIVHEMATPKREWSAKQKWRDIYGTTFPD

SEQ ID NO: 5396 - protein, 293 aa, Klebsiella pneumoniae
MGLAEWFCGFCSNLTVKDGGTISARYKNITRRLNNDFWGSISDTTHSLYVGSYGRNTATQGFSDLDMIFQLPYSEYIKYNSYLGNGQSALLQSVKRSIEKTYAKTNVRGDGQVIQVPFSDGIIFEVVPAFLNDDNSYTFPDANGGGRWRTTNPRPEIAAMQLRNDLTYRNLVQLCRMARAWKRKWDVPISGLLIDTLAYQFIEQWPHRDKSYLYYDFMSRDFFKWLGEQDTSKEFWRAPGSGQYVYGKGLFQYKAKRCYNISLEAIEHEMAIPKREWSAKQKWREIYGTTFPD

SEQ ID NO: 5397 - protein, 293 aa, Enterobacter cloacae
MGLGEWFGGFCSNLTVKDGGTISTRYRNITKRLNTDFWGSASETTHSLYVGSYGRNTATESMSDLDMIFQLPYSEYTKYNGYLGNGQSALLQSVKKSIEKTYWNTSIRGDGQVILVPFNDGITFEVVPAFINVDNSYTYPDANNGGRWRTTNPKPEISAMKLRNDLTNKNLVQLCRMTRAWKKEWNVPISGLLIDTLAYQFIENWGFKDKSYYYYDFMSRDFFKFMADQSTSKEYWKAPGSGQYVYGKGLFQYKAKQCYNIALEAISHELANPKREWSAKQKWREIYGKTFPN

SEQ ID NO: 5398 - protein, 293 aa, Proteus mirabilis
MGLAEWFCDFSSNLVVKDSGTISTRYRNITKRLNTDYWSSISETSHSLYVGSYGRNTAIQGFSDLDMIFQLPYSEYVKYNNYEGNGQSALLQSVKQSIEKTYAVTKIRGDGQVVLVPFNDGITFEVVPAFINRDNSFTYPDANGGGRWRTTNPKPEISAMKFRNDATNRNLVQLCRMTRAWKRKWDVPIGGLLIDTLAYQFIENWAYRDKSYLYYDYMSRDFFKWMAEQDVNKEYWKSPGSGQYVYGKGLFQYKAKRCYNISLEAIEHEIATPKREWSAKQKWREIYGTAFPA

SEQ ID NO: 5399 - protein, 290 aa, Unknown
  Description of Unknown: Bathymodiolus azoricus thioautotrophic gill symbiont sequence
MNLSEWFSDFCAELTVKDGGIISTRYKNITKRLNTDYWSTTFDTNHSLYVGSYGRGTATQGFSDLDMIFRLPDKEYEKYNNYADNGQSALLQAVKKSIEKTYPTSSIRGDSQVISVPFNDGITFEVVPAFAKNDDSFTFPDANNGGSWKTTDPKPEIEAIRNRDNVCNGNLKRLCRMMRAWKRKWEVPIGGLLIDTLAYQFIENWKYRDKSYLYYDYMSRDFFKWMSEQDSKKTYWRSPGSSQYVYVKDLFQYKAKKCYKISLEAIQHETTDPRSAKQKWREIYGTTFPD

SEQ ID NO: 5400 - protein, 294 aa, Planctomycetes bacterium
MGLADWFSTFCGNIKVKNGDSISCRYKAITKRLNADFRGTTSETANSLYVGSYGRNTAIHGTSDMDMIFVLPCSTYQHYNNYNGNGQSALLQAVRTSLQKTYSTTKIGADGQVIVITFDNGITFEIVPGFVNKGGSYTYPDSNGGGRWKTTNPKPEIEAIRTRNSECNNNLVPLCRMMRAWKAKMNVPIGGLLIDTLAYQFIGTWKYRDKSYFYYDYMCRDFFAFMANQDKAQEWWNAPGSGQRVHGPKGQFQCKATRGYNLAREAIKHEIADPKQEWSAKQKWREIFGTSFPS

SEQ ID NO: 5401 - protein, 291 aa, Flexilinea flocculi
MGVGEDFKTFCDNLAISRRDVISSRCKAITQRLNKDYYGYDSEIYNSFYGGSFGRGTAINSTSDVDLLFELPSSVYHQYDNYSGNGQSALLQAVKNSIKQTYASSEVGADGQVVVVSFSDGIVFEVLPVFLNTSNSYTFPDSNDGGSWKTTNPKPEIKAIQDMDNSCNENLKRLCKMMRSWKIQWNVPIRGLLIDTLAYNFISSWGSRDKSYLYYDWLSRDFLFYLNQRDANQSYWLAPGSNQYVWRSGNFEYKAGQCYNLALEAIQQAKDNKTWSSKQTWRKIYGTDYPE

SEQ ID NO: 5402 - protein, 292 aa, Deinococcus aquatilis
MSVSQDFETLCNNLVIRNGALISSRYQSITARLNKDFHAIDSYVQNTIQVGSYGRDTAIVDAHDVDVLFKLPFSVYQQYNGYLSNGQSALLQAVRNSIQRTYPSTAVGGDGQVVVVSFADQMRFEVLPAFLNSDSISYTHADSNNGGSWKTTNPQAEINEIHRLNGLYNKNLKRLCRMARAWRRHCGVQLSGIQIDTLAAQFMASWGYKDKSYLYYDYLTRDFMKYLADQDKTQVYWRAPGSGSFVWRKGPFEAKAGAAYQAALEGTDLYAKNKTTAARGKFREIYGNNYPR

SEQ ID NO: 5403 - protein, 292 aa, Chlorobium limicola
MSEAVYFEIFCTDLLVGTTMRSTISTRYLAICTRLNKDFWNMDTTTGGRYVGSFGRNTANSWISDIDMLFEMPWSTYTTYNSYISNGQSALLQAVKNSIAKTYPSTSLKGDGQIVLVKFTDGMEFEVLPAFKNTDELYTFADSNGGGSWKKTNPIPEIKSISTGDILTNNNLRHLCRMTRAWKYYCNVPINGLLIDTLAYRFLTNWSNRDKSYLYYDLMCRDFFEYLKNQTENQTIWYAIGSCQTIYNPENFRYKATVAFNKSKEAIKYQTDKIECSAKQKWREIYGTRFPS

SEQ ID NO: 5404 - protein, 293 aa, Chryseobacterium sp.
MSEAVYFENFSNNLLIGSTLRSTISMRYINICKRLNKDFWNMDDCTTGGRYIGSFGRNTATGWISDIDILFEMPWRFYLNYNDYIGNGQSAFLQVVKNSIAKTYPTTSLKGDGQIVSIKFADGMEIEVLPVFKNNDDSYTFADSNDGGSWKTTNPIPEINMIGIGDSLTNYNLRSLCRMTRAWKHFCSVPIKGLLIDTLAYRFLINWENRNKSYLYYDLMCRDFFEYLKNQSQNQSTWSALGSNQIIYNPENFQYKATIAYNKAKEAIKYQNDKMEWSAKQKWKEIYGNRFPN

SEQ ID NO: 5405 - protein, 292 aa, Confluentibacter lentus
MSVTTNFETFCNNLLITQTKRSTISDRYLAICKRLNKDFWGMDTTSGGRYVGSFGRNTANSYVSDIDMLFEMPLSTYNTYNAYISNGQSALLQAVKNSIATTYPNTSLRGDGQIVQVTFSDSMKFEVLPAFKNDDGSYTYANSNNGGSWKKTNPVPEISAVSCGDGLTNNNLRPLCRMARAWKYYNSVPISGLLIDTLAHRFLTAWSNRDKSYLYYDFMSRDFFSYLKNQDANQNTWYAIGSGQSIYNPDNFRYKATVAYNKSLEAIQQETDNFTWSAKQKWREIYGNRFPE

SEQ ID NO: 5406 - protein, 314 aa, Burkholderia multivorans
MRPSADCFQGEITIERRREEMGEGEWFSQFCGTLRINAEKRGSISYRTGRIVGQLNYDLRDKLDSNSAYRFYVGSYGRSTAIPSVSDVDLLYELPYALYQRFHGHAGNGQSALLALVKNSIRNTYRVSDMAGDGQVVVINFDDGVRFEVLPAFVNTDGSYTFADSNGGGAWRVCKPKHEMNAFSTRNAACNENLVELSRMARAWRDTNNVSMSGMLIDTLAYQFIANWAHRDKSYLYYDYLTRDFFNYLANLDASQTYWLAPGSGSYVYRSDVFQFKARSAELRAIEAIAHQLKGENWSARQKYRAIYGTAFPA

SEQ ID NO: 5407 - protein, 294 aa, Burkholderia multivorans
MGEGEWFSQFCGTLRINAEKRGSISYRTGRIVGQLNYDLRDKLDSNSAYRFYVGSYGRSTAIPSVSDVDLLYELPYALYQRFHGHAGNGQSALLALVKNSIRNTYRVSDMAGDGQVVVINFDDGVRFEVLPAFVNTDGSYTFADSNGGGAWRVCKPKHEMNAFSTRNAACNENLVELSRMARAWRDTNNVSMSGMLIDTLAYQFIANWAHRDKSYLYYDYLTRDFFNYLANLDASQTYWLAPGSGSYVYRSDVFQFKARSAELRAIEAIAHQLKGENWSARQKYRAIYGTAFPA

SEQ ID NO: 5408 - protein, 294 aa, Burkholderia stagnalis
MGEGEWFSQFCGALRINAEKRGSISYRTGRIVGQLNYDLRDKLDSKSAYRFYVGSYGRSTAIPSVSDVDLLYELPYALYQRFHGHAGNGQSALLALVKNSIRNTYRVSDMAGDGQVVVINFDDGVRFEVLPAFVNTDGSYTFADSNGGGAWRVCKPKHEMNAFSTRNAACNENLVELSRMARAWRDTNNVSMSGMLIDTLAYQFIVNWSHRDKSYLYYDYLTRDFFNYLANLDTSQTYWLAPGSGSYVYRSDVFQFKARSAELRAIEAIAHHLKGENWSARQKYRTIYGTAFPA

SEQ ID NO: 5409 - protein, 294 aa, Burkholderia sp.
MGEGEWFSQFCGALRINAEKRGSISYRTGRIVGQLNYDLRDKLDSKSAYRFYVGSYGRSTAIPSVSDVDLLYELPYALYQRFHGHAGNGQSALLTLVKNSIRNTYRVSDMAGDGQVVVINFDDGVRFEVLPAFVNTDGSYTFADSNGGGAWRVCKPKHEMNAFSTRNAACNENLVELSRMARAWRDTNNVSMSGMLIDTLAYQFIFNWSHRDKSYLYYDYLTRDFFNYLANLDTSKTYWLAPGSGSYVYRSDVFQFKARSAELRAIEAIAHQLKGENWSARQKYRAIYGTAFPA

SEQ ID NO: 5410 - protein, 294 aa, Burkholderia ubonensis
MGEGEWFSQFCGALRINAEKRGSISYRTGRIVGQLNYDLRDKLDSKSAYRFYVGSYGRSTAIPSVSDVDLLYELPYALYQRFHGHTGNGQSALLALVKNSIRNTYSVSDIAGDGQVVVINFDDGVRFEVLPAFENVDGSYTFADSNGGGSWRVCKPKHEMNAFSARNTACNGNLVELSRMARAWRDTNNVSMSGMLIDTLAYQFIANWSHRDKSYLYYDYLTRDFFNYLANLDTSQTYWLAPGSGSYVYRSDVFQFKARSAELRAIEAIGHQLKSENWSARQKYRAIYGTAFPA

SEQ ID NO: 5411 - protein, 294 aa, Unknown
  Description of Unknown: Burkholderia sequence
MGEGEWFSQFCGALRINAEKRGSISYRTGRIVGQLNYDLRDKLDSKSAYRFYVGSYGRSTAIPSVSDVDLLYELPYALYQRFHGHTGNGQSALLALVKNSIRNTYSVSDMAGDGQVVVINFDDGVRFEVLPAFENVDGSYTFADSNGGGSWRVCKPKHEMNAVSARNTACNGNLVELSRMARAWRDTNNVSMSGMLIDTLAYQFIANWAHRDKSYLYYDYLTRDFFNYLANLDTSQTYWLAPGSGSYVYRSDVFQFKARSAELRAIEAIGHQLKGENWSARQKYRAIYGTAFPA

SEQ ID NO: 5412 - protein, 294 aa, Burkholderia ubonensis
MGEGEWFSQFCGALRINAEKRGSISYRTGRIVGQLNYDLRDKLDSKSAYRFYVGSYGRSTAIPSVSDVDLLYELPYALYQRFHGHTGNGQSALLALVKNSIRNTYSVSDMAGDGQVVVIDFDDGVRFEVLPAFENVDGSYTFADSNGGGSWRVCKPKHEMNAVSARNTACNGNLVELSRMARAWRDTNNVSMSGMLIDTLAYQFIANWAHRDKSYLYYDYLTRDFFNYLANLDTSQTYWLAPGSGSYVYRSDVFQFKARSAELRAIEAIGHQLKGENWSARQKYRAIYGTAFPA

SEQ ID NO: 5413 - protein, 294 aa, Burkholderia ubonensis
MGEGEWFSQFCGALRINAEKRGSISYRTGRIVGQLNYDLRDKLDSKSAYRFYVGSYGRSTAIPSVSDVDLLYELPYALYQRFHRHTGNGQSALLALVKNSIRNTYSVSDMAGDGQVVVINFDDGVRFEVLPAFENVDGSYTFADSNGGGSWRVCKPKHEMNAVSARNTACNGNLVELSRMARAWRDTNNVSMSGMLIDTLAYQFIANWAHRDKSYLYYDYLTRDFFNYLANLDTSQTYWLAPGSGSYVYRSDVFQFKARSAELRAIEAIGHQLKGENWSARQKYRAIYGTAFPA

SEQ ID NO: 5414 - protein, 294 aa, Paraburkholderia ribeironis
MGEGEWFSQFCGALRINAEKRGSISYRTGRIVGQLNYDLRDELDSKSAYRFYVGSYGRSTAIPSVSDVDLLYELPYALYQRFHGHAGNGQSALLALVKNSIRNTYRVSDMAGDGQVVVINFDDGVRFEILPAFVNVDGSYTFADSNGGGSWGVCKPKHEMDAFAARNAACNQNLVELSRMARAWRDTNNVSMSGMLIDTLAYQFIANWEHRDKSYLYYDFMTRDFFRCLANLDTAQLYWLAPGSGSWVFRGDVFQYKARSAELRATEAIVHQAKGENWSARQKYRAIYGTAFPE

SEQ ID NO: 5415 - protein, 294 aa, Ralstonia solanacearum
MGEGEWFSQFCGALRINAEKRSSISYRTGRIVGQLNYDLRNKLDSKSAYRFYVGSYGRGTAIPSVSDVDLLYELPYALYQRFHGHTGNGQSALLALVKNSIRNTYSVSDMAGDGQVVVINFDDNVRFEILPAFVNTDGSYTFADSNGGGSWRVCRPKHEMDAFSARNVACNQNLVELSRMARAWRDTNNVSMSGMLVDTLAYQFIANWEYRDKSYLYYDFMTRDFFRYLANMDTSQTYWLAPGSGSYVYRSDVFQHKARSAELRAIEAITHIAAGENWSARQKFRAIYGTAFPA

SEQ ID NO: 5416 - protein, 293 aa, Paraburkholderia monticola
MGVGEWFSVFCGSLRINGEKRTSLANRTARIVGRLNSDLRCLNSDTSYRFYVGSYGRSTAIPSVSDVDLLYELPYALYARFHGHAGNGQSALLGLIKDSLRRTYNVSDMAGDGQVVVINFTDGVRFEVLPAFVNTDGSYTFADSNNGGAWRICKPKHEMEAFSARNVACNYNLVELSRMVRAWRDTNNVSMSGMLIDTLAYQFLGTWTYRDKSYVYYDWMTRDFFNYLANLDKQQTYWLAPGSGSYVYRSDVFQYKARSAELRALEALEYQQSNHDWSARQKYREIYGTAFPA

SEQ ID NO: 5417 - protein, 293 aa, Burkholderia multivorans
MGEGEWFASFCCKLRIDKDKRESIAYRTGRMVGQLNADLRSLNSSTSYRFYVGSYGRGTAIPSVSDVDLLYELPYDLYVRFNGYAGNGQSALLALVKNSIRKTYRVSDLVGDGQVVVIRFDDNIHYDILPAFVNRDGSYTFADSNGGGSWRVCNPKKEMETFANRDAACNYNLGELSRMARAWRDANKVDMSGMLIDTLSYQFIGSWQYRDKSYLYYDLLTRDFFQYLAGLDLNQMYWLAPGSGSYVYRGQPFQYKARSAELRACEAINYQGLGCNWSARQKYREIYGTAFPE

SEQ ID NO: 5418 - protein, 293 aa, Burkholderia gladioli
MGEGEWFASFCGKLRIDKDKRESIAYRTGRMVGQLNADLRSLNSNTSYRFYVGSYGRGTAIPSVSDVDLLYELPYDLYVRFNGYAGNGQSALLALVKNSIRKTYRVSDLVGDGQVVVIRFDDNIHYDILPAFVNKDGSYTFADSNGGGSWRVCNPKKEMEAFAGRNAACNYNLGELSRMARAWRDTNNVDMSGMLIDTLAYQFIIGWGHRDKAYSYYDYMTRDFFQYLAGQNINQTYWLAPGSGSYVHRGQPFQYKARSAELRAREAIAFQLANRNWSARQKYREIYGTAFPE

SEQ ID NO: 5419 - protein, 293 aa, Burkholderia ubonensis
MGEGEWFANFCGALRMSKATRESIAYRTARMAGQLNADLRNLNSNTSYRFYVGSYGRSTAITSVSDVDLLYELPYELYVRFNGHAGNGQSALLALVKNSIRKTYRVSDMAGDGQVVVIKFDDNIRYDILPAFVNKDGSYTFADSNGGGSWRVCNPKKEMEAFAQRNKACALNLVELAMMVRAWRDFNNVDMSGMLIDTLAYQFIATWPHRDKSYVYYDYLTRDFFQYLAGLDLQKTYWLAPGSGSYVYRGQPFQYKARSAELRAREAIDYQGRSQNWSARKKYREIYGPAFPA

SEQ ID NO: 5420 - protein, 293 aa, Burkholderia ubonensis
MGEGEWFANFCGALRMSKATRESIAYRTARMAGQLNADLRSLNSNTSYRFYVGSYGRSTAITSVSDVDLLYELPYELYVRFHGHAGNGQSALLAHVKNSIRKTYRVSDMAGDGQVVVIKFDDNIRYDILPAFVNKDGSYTFADSNGGGSWRVCNPKKEMEAFAQRNTACALNLVELSRMVRSWRDANNVDMSGMLIDTLAYQFIATWPHRDKSYVYYDYLTRDFFQYLAGLDTQKTYWLAPGSGSYVYRGQPFQYKARSAELRAREAIDYQGRNQNWSARQKYREIYGPAFPS

SEQ ID NO: 5421 - protein, 293 aa, Burkholderia ubonensis
MGEGEWFANFCGALRMSKATRESIAYRTARMAGQLNADLRSLNSNTSYRFYVGSYGRSTAITSVSDVDLLYELPYELYVRFHGHAGNGQSALLAHVKNSIRKTYRVSDMAGDGQVVVIKFDDNIRYDILPAFVNKDGSYTFADSNGGGSWRVCNPKKEMEAFAQRNTACALNLVELSRMVRSWRDANNVDMSGMLIDTLAYQFIATWPHRDKSYVYYDYLTRDFFQYLAGLDTQKTYWLAPGSGSYVYRGQPFQYKARSAELRAREAINYQGQNQNWSARQKYREIYGPAFPS

SEQ ID NO: 5422 - protein, 293 aa, Unknown
  Description of Unknown: Burkholderia cepacia complex sequence
MGEGEWFTSFCGKLRIDKGKRESIAYRTGRIVGQLNSDLRKLDSKWANRFYVGSYGRYTAIPSVSDVDLLYELPAHLYKQFDVYMWNGQSSLLNLVRNSIGNTYPTSAVSGDGQVVVISFTDNVRFEILPAFANQGGGYTFADSNQGGSWKTCKPKQEMEAFANRNAACNGNLGELSRMVRAWRDTNNVDLSGMLIDTLAYQFIGAWQHRDKSYLYYDLLTRDFFQYLAGLDLNQTYWLAPGSGSYVYRGQPFQYKARSAELRAREAIDYQWVGYNWSARQKYREIYGTAFPE

SEQ ID NO: 5423 - protein, 293 aa, Dyella japonica
MGEGQWFTDFCSALTIGRDKRDSVAARTGRIVGQLNHDLRNLDSKSANRFYVGSYGRNTSIPSVSDVDVVYELPVALYERFHRHAGNGQSALLAYVRNSIQNTYPTSVVAGDGQVVVIHFTDGIRFEILPAFSNVADTYTFADSNGGGTWRECKPKQEMAAFSARNAQCNNNLVSLCRMVRAWRDHNKVGMSGMLIDTLAYQFIATWEHRQNSYAYYDYLTRDFFKYLAGLDPNKTYWQAPGSGSYVYRGDAFQYKARSAELRALEAIQYQLANHNWSARQKYREIYGTSFPE

SEQ ID NO: 5424 - protein, 294 aa, Burkholderia cenocepacia
MGVGEWFSDFCGALRIDSEKRSSISYRTGRIVGQLNYDLRNKLDSKTSNRFYVGSYGRSTAIPSVSDIDLLYVLPYELYERFHGYIGNGQSALLTHVKNSISNTYSTTYLASDGQIVAINFTDGVKFEILPAFVNNDGSYTFADSNDGGSWRICKPKHEMDEFSARSAVCKSNLVELSRMARAWRDTNNVSMSGMLIDTLAYQFIGTWTYRDKSYLYYDWMTRDFFNYLANLDTQQTYWLAPGSNSRVYRSDIFQYKARSAELRAIEALGFQQNNHDWSARQKYREIYGTAFPA

SEQ ID NO: 5425 - protein, 294 aa, Burkholderia territorii
MGVGEWFSDFCGALRIDSEKRSSISYRTGRIVGQLNYDLRNKLDSKTSNRFYVGSYGRSTAIPSVSDIDLLYVLPYELYERFHGYIGNGQSALLTHVKNSISNTYSTTYLASDGQIVAINFTDGVKFEILPAFVNNDGSYTFADSNDGGSWRICKPKHEMDEFSARNAVCKSNLVELSRMARAWRDTNNVSMSGMLIDTLAYQFIGTWTYRDKSYLYYDWMTRDFFNYLANLDTQQTYWLAPGSNSRVYRSDIFQYKARSAELRAIEALGFQQNNHDWSARQKYREIYGTAFPA

SEQ ID NO: 5426 - protein, 294 aa, Burkholderia sp.
MGVGEWFSDFCGALRISGDKRKSIAYRTGRIVGQLNYDLRDKLESPTANRFYVGSYGRSTAIPSVSDIDLLYQLPYALYERFHGHAGNGQSALLTHVKNSISNTYSTTYLASDGQIVAINFTDGVRFEILPAFLNNEGGYTFADSNNGGSWKSCKPKHEMDEFSARNLACNSNLTELSRMARAWRDANNVSMSGMLIDTLAYQFIGTWAYRDKSYLYYDYMTRDFFNYLANLDMQQTYWLAPGSNSRVYRSDIFQYKARSAELRAIEALGLQQNNHDWSARQKYREIYGTTFPA

SEQ ID NO: 5427 - protein, 292 aa, Burkholderiales bacterium
MGVGDWFQTFCGNIRIGTEKRSSIGYRTGRIVGQLNADLRGLESKTSYRFYVGSYGRSTAIPSVSDVDLLYELPNELYARFNGRAGNGQSALLAHVRASIQKTYSVTEIGGDGQVVVLRFDDGVKFEVLPAFPNTEGGYTFANTNNGGSWRACKPKQEMTAFSTRNTECNGNLVELARMTRAWRDQNNVSMSGMLIDTLAYQFINGWAYKDKSYVYYDWMTRDFFAFLAGQDAGKTYWTAPGSGSWVYGSGFQYKARQAELRTKEAIDYQQNNCDYSAKQLYRGIYGTDFPS

SEQ ID NO: 5428 - protein, 292 aa, Acidovorax sp.
MGVGDWFQTFCGNIRIGTEKRGSIGYRTGRIVGQLNADLRGLDSKTSYRFYVGSYGRSTAIPSVSDVDLLYELPNELYARFNGHAGNGQSALLAHVRASIQKTYSVTEIGGDGQVVVLRFDDGVKFEVLPAFLNTEGGYTFADTNNGGSWRACKPKQEMTAFSTRNTECNGNLVELARMARAWRDQNNVSMSGMLIDTLAYQFINGWAYKDKSYVYYDWMTRDFFAFLAGQDAGKTYWTAPGSGSWVYGSGFQYKARQAELRTKEAIDYQQNNYDYSAKQLYRGIYGTDFPS

SEQ ID NO: 5429 - protein, 292 aa, Acidovorax sp.
MGVGDWFQTFCGNIRIGTEKRSSIGYRTGRIVGQLNADLRGLDSKTSYRFYVGSYGRSTAIPSVSDVDLLYELPNELYARFNGHAGNGQSALLAHVRASIQKTYSVTEIGGDGQVVVLRFDDGVKFEVLPAFLNTEGGYTFADTNNGGSWRACKPKQEMTAFITRNTECNGNLVELARMARAWRDQNNVSMSGMLIDTLAYQFINGWAYKDKSYVYYDWMTRDFFAFLAGQDAGKTYWTAPGSGSWVYGSGFQYKARQAELRTKEAIDYQQNNYDYSAKQLYRGIYGTDFPS

SEQ ID NO: 5430 - protein, 292 aa, Bordetella genomosp. 9
MGVGDWFQTFCGNLRISPDKRSSIGYRTGRIVGQLNADLRGLASKTSYRFYVGSYGRSTAIPSVSDVDLLYELPSDLYARFNVHVGNGQSALLAHVRASIMKTYSITEIGGDGQVVVLRFDDGVKFEVLPAFPNMDGGYTFADTNNGGSWRTCKPKQEISAFSMRNTLCNGNLVQLSRMARAWRDQNNVSMSGMLIDTLAYQFIDGWAHKDKSYVYYDWMTRDFFGFLAGQDAQKTYWTAPGSGSWVYGGGFQYKARQAELRTKEAIDYERQNYAYTAKQIYRGIYGSAFPS

SEQ ID NO: 5431 - protein, 292 aa, Bordetella bronchiseptica
MGVGDWFNSFCGNIRISPEKRSSLAYRTGRIVGQLNADLRDLESKTSYRFYVGSYGRSTAIPSVSDVDLLYELPAALYERFNKHQGNGQSALLSHVRTSIQRTYPTSKIGGDGQVVVIVFDDGVTFEVLPAFLNTANGYTFADSNDGGSWRTCQPKQEMSAFSTRNNECCGNLIELARMTRAWRDKNGVPMSGMLIDTRAYQFIGTWQYRDKSYLYYDWMTRDFFEFLARQNTMQTYWSAPGSGSRVYGGGFQYKARQGELRTREAIDNQRNNYDYTAKQIYRGLYGTAFPS

SEQ ID NO: 5432 - protein, 293 aa, Hydrogenophilales bacterium
MGVADWFSAFCTSIRIGTDLRSSIAYRTKRITKQLNMDSRSSSSDTANSFYAGSYGRSTAVPSVSDIDLVYVLPYEVYEQHDKLKGNKQSTLLQAVRNTIRKTYPTSAISGDGQVVAIVFNDGITYEILPAFLNKDGSYTYPDSNNGGSWKVCKPKHELDAFLTRNAECNGNLVELGRMARAWRDYNNVPMSGMLIDTLAYQFIAAWSHRDKSYLYYDYLTRDFFNFLAAQSEAQTYWLAPGSNSYVWRKGKFEYKARQAELRALEAIEHQANNREWSAKQKFREIYGTAFPD

SEQ ID NO: 5433 - protein, 293 aa, Achromobacter piechaudii
MSVADWFSTFCGALPPGILKRASIADRTGRLTRRLNSDFRDSTSDTANRFYGGSYGRNTAVASVSDIDLMYVLPYSIYKQYDGHSSNGQSALLQSVKRSIEVTYPNSVVIADGQIVQIPFTDNVTFEIVPVFLNTDGSYTFADDNNGGSWKVCWPKDEINAFATRNQACNYNLVPLGRMVRAWRDTNDVPMSGMLIDTLAYQFIETWEHRLKSYLYYDFMTRDFFNFLANQDSSQNHWRAPGSQSWARRTGGFERKARMAHTLAVDAIKNVLANENWAAKNKFRQIYGTQFPS

SEQ ID NO: 5434 - protein, 293 aa, Bordetella genomosp. 5
MSVADWFSTFCSALPPGILKRASIADRTGRLTRRLNSDFRESTSDTANRFYGGSYGRNTAVASVSDIDLMYVLPYSIYKQYDGHSSNGQSALLQSVKRSIEVTYPNSVVIADGQIVQIPFTDNVTFEIVPVFLNTDGSYTFADANNGGSWKVCWPKDEISAFATRNQACNYNLVPLGRMVRAWRDTNDVPMSGMLIDTLAYQFIETWEHRLKSYLYYDFMTRDFFNFLANQDLNQNHWRAPGSQSWARRTGGFERKARMAHTLAVDAIKNVLANENWAAKNKFRQIYGTQFPS

SEQ ID NO: 5435 - protein, 293 aa, Mesorhizobium metallidurans
MGVSDEFYNFRNNYNIGTDLISSIGQRYRRITTRLNTDFWNTDSSSAHSLYVGSYGRDTAARGISDLDIGFQLPYAEYVKYSAYQGNGQSALLQAVKNSLLKTYGSSKVGGDGQVVVISFTDGITFEILPYFNNTDDSWTFADSNGGGTWRQCNPRAEMNAVQTRNTAVNGNLKALCRMMRVWKDHNSVPMTGALIDALAYQFIETWGYRDKSYGYHDYMARDFLKYLYDLDREKTYWRMPGSGSYVYKTGVFWLKALTDYNIAVEACNMQTDDKAAQRRAKWRSVFGTTFPI

SEQ ID NO: 5436 - protein, 293 aa, Mesorhizobium sp.
MGVSDEFYNFRNNYNIGTDLISSIGQRYRRITTRLNTDFWNTDSSSAHSLYVGSYGRDTAARGISDLDIGFQLPYAEYVKYSAYHGNGQSALLQAVKNSLLKTYGSSKVGSDGQVVVISFTDGITFEILPYFNNTDGSWTFADSNGGGTWPRCNPRAEMTAVQTRNTAVNGNLKALCRMMRVWKDQNSVPMTGALIDALAYQFIETWEYRDKSYGYHDYMARDFLKYLYDLDREKTYWRMPGSGSYVYKTGVFWLKALTDYNIAVEACNMQTDDKAAQRRAKWRTVFGTTFPI

SEQ ID NO: 5437 - protein, 293 aa, Unknown
  Description of Unknown: Mesorhizobium sequence
MGVSDEFYNFRNNYNIGTDLISSIGQRYRRITTRLNTDFWNTDSSSAHSLYVGSYGRDTAARGISDLDIGFQLPYAEYVKYSAYQGNGQSALLQAVKNSLLKTYGSSNVGGNGQVVVISFTDGITFEILPYFDNTDGSWTFADSNGGGTWRQCNPRAEINAVQTRNTAVNGNLKALGRMMRVWKDHNSVPMTGALIDALAYQFIETWEYRDKSYGYHDYMARDFLKYLYDLDREKTYWRMPGSGSYVYKTGVFWLKALSDYNIAVEACNMQTDDKAAQRRAKWRIVFGTTFPI

SEQ ID NO: 5438 - protein, 293 aa, Gemmobacter megaterium
MGVYNEFYAFKDNYNIGTDLISSIGRRYRRITARLNKDFWDTDSETAHSLYVGSYGRDTAAKGISDLDVGFRLPYDLYAKFDAYQVNGQSALLQSVRASLQKTYPTSNIGGDGQVVVIKFDDGVTFEILPYFDNKGGTWTYPDSNGGGSWKTCNPKAEIEAVHNRNLLVNRNLKPLCRMMRVWKDHNDVPMTGALIDTLAYQFIDTWSHKAQSYGYHDFMARDFLKYLYEQNESQQFWLMPGSGSRAYRTGVFWRKALTDYNIAVEACLLQTDSVAIERRAKWRSVFGPTFPV

SEQ ID NO: 5439 - protein, 293 aa, Agrobacterium tumefaciens
MGVADEFTNFKNAYNIDKSLISSIAYRYQRITGQLNKDFRGIESKTANSLYVGSYGRDTSARGISDIDMAYALPALLYYQYDAYTTNGQSALLQAIKKSIQKTYTTSESFGDGQVVVVKFDDGLTFEILPVFDNKAGTWTYPNANNGGSWQACNPRAEIDAIHNRNLANNRNLKHLCRMMRVWRDYNDAPISGALIDTLAYQFIETWEHRDKSFLYHDYMARDFLKYLSDQDKDKTYWRMPGSSSYVWKKGNFQSKAIVDYNIAVTACGLQKEEEGAQRRSKWRSVFGPTFPN

SEQ ID NO: 5440 - protein, 294 aa, Sphingomonas sp.
MGVGEDFSRFKDGYNIDASTMASISYRYRRITRQLNKDFWNTESETTHSLYVGSYGRDTAARGLSDLDVGFVLPNSLYHQYNAHLGNGQSALLQAVKRSIQKTYTTSESFGDGQVVVVSFTDGITFEILPAFDNSDGDSWTYPNANGGGSWKTCNPRAEMRAVDTRSLLTNRNLKYLCRMMRVWRDVHSVPMSGMLIDTLAYQFIEGWAHRDKSFFYHDYMARDFFLYLSQRDTTQSYWRAPGSGALVARKGAFERKAASAYAKALEAITYDANGHDWSRRQKWREIFGTLFPA

SEQ ID NO: 5441 - protein, 295 aa, Unknown
  Description of Unknown: Thalassospira sequence
MSVADDFIRFNNAYNIDRDTIASISYRYRRITRQLNSDFWNTASDTAHSLYAGSYGRDTAARGLSDLDIGFVLPVAFYHKYNGYQYNGQSALLQAVKTSIRKTYKTSDSFGDGQVVVVKFTDNITFEVLPVFEHVDGESWIYPNTNHGGSWKTCNPRAEIAAVKKRNSETNKNLKRLCRMMRAWRDYNNVPMSGMLIDTLAYQFIANWVHRDKSYLYHDYMARDFFAYLAALDTNQSYWRAPGSGSNVAKKGHFHWKARVAYNQSVQAILHDQNGQVWSRRQMWRKIFGPAFPAA

SEQ ID NO: 5442 - protein, 292 aa, Bradyrhizobium japonicum
MGVGEDFSKFKDNYQISSELISSISYRYKRITRQLNSDFWTTNSETAHSLYVGSYGRDTAAKGISDLDIAFILPNADYHKYNAYQNNGQSALLQAVKRSIQKTYKTSESFGDGQVVVITFTDGLTFEVLPVFENKDSDSFTYPNANAGGSWKVCNPRAEIAAVSKRSENTNTNMKYLARMGRIWCKHCDVPMSGMLIDTLGYQFIETYEHRDKSFLYHDWMMRDFFDFLSKQDQQKSYWRAPGSGSSVTRKGVFEFKARSAYLRACEAIAFGDKEWSRRQKWREVFGSLYPG

SEQ ID NO: 5443 - protein, 292 aa, Bradyrhizobium canariense
MGVGDDFSKFKENYKITIELISSISYRYKRITRQLNSDFWTTNSETAHSLYVGSYGSDTAAKGISDLDIAFILPNADYHKYNAYQNNGQSALLQAVKKSIQKTYSTSESFGDGQVVVITFTDGLTFEVLPVFENKDSDSFTYPNANAGGSWKVCNPRAEMAAVSKRSDATNTNMKYLARMARIWCKHCDVPMSGMLIDTLGYQFIETHEHRDKSFLYHDWMMRDFFDFLSKQDQQKTYWRAPGSGSSVARKGIFEFRARSAYLRACEAIAFDDKEWSRRQKWREVFGSLYPG

SEQ ID NO: 5444 - protein, 292 aa, Bradyrhizobium sp.
MGVGDDFSKFKDNYQISVELISSISYRYKRITSQLNSDFWTTNSETAHSLYVGSYGRDTAAKGLSDLDIAFILPNAEYHKYNSYQTNGQSALLQAVKKSIQKTYSTSESFGDGQVVVITFTDGLTFEVLPVFENKDSDSFTYPNANAGGSWTVCNPRAEIEAISKRSEATNRNMKYLARMGRVWCNHCDVPMSGMLIDTLGYQFIETYQYRDKSFVYHDWMMRDFFDFLSKQDQKQTYWRAPGSGSSVTRKGVFEFKARSAYLRACEAIAFDDKEWSRRQKWREVFGSLYPG

SEQ ID NO: 5445 - protein, 294 aa, Bradyrhizobium sp.
MGVGEDFQKFKDNYQITTELITSISYRYKRITRQLNTDFWNTNSDTAHSLYVGSYGRDTAAKGLSDLDIGFILPNAVYHQYNGYQGNGQSALLQAVKRSMQKTYPTSEVSGDGQVVVISFNDNLTFEVLPAFENQNSESWTYPNANNGGSWKVCNPRAEIAAIDTRSALTNKNLKYLGRMMRIWARHCAVPISGMLIDTLAYQFIETYPHRDKSFLYHDYMARDFFDYLSKQDQNQTVWRAPGSGSHVHRKGVFEHKARSAYLRATEAIKYNDDNYEWSRRQKWREVFGTLYPG

SEQ ID NO: 5446 - protein, 270 aa, Bradyrhizobium yuanmingense
MGVGEDFQKFKNNYQITTEQIASISYRYKRITRQLNTDFWNTNSETAHSLYVGSYGRDTAAKGLSDLDIGFILPNTVYHQYNNHQGNGQSALLQAVKKSIQKTYRTSESFGDGQVVVISFDDNVTFEVLPAFENSSNSWTFPNANNGGSWKDCNPRAEIAAIDTRSALTNKNLKYLGRMMRVCAPLRGPNQRHVDRHVGVSVHRDLSAPRQVVLLSRFHGARFFRLPVKTRSEPDRLARARQRLSRPPQRRVRTQGAQRISARERGDPVQ

SEQ ID NO: 5447 - protein, 294 aa, Afipia sp.
MGVGEDFATFRDNYQITQEKISSISYRYKRITRQLNTDFRDNTSDTANSMYVGSYGRDTAAKGLSDLDMAFILPYAEYAKYHAFSTNGQSALLQAVKRSIQNTYPISESFGDGQVVVITFDDGVRFEILPVFNNKDSDSWTYPNANNGGSWKVCNPRAEIKAVAKRSAETNKNLKYLGRMTRVWCAHCSVPMSGMLIDTLAYQFIENYVNRDKSFLYHDLMMRDFFEFLSQQVQTQTVWRAPGSGSRVGRTGIFEHKARSAQLRSIEAVNFDLAHQEWSRRQKWREVFGTLYPD

SEQ ID NO: 5448 - protein, 293 aa, Rhizobium sp.
MGVAEDFRAFRTSYLIPMETVGSISYRYKRITKQLNKDFWATDSEAAHSLYVGSYGRDTAAKGVSDLDVSFTLPNSLYATYNSYTGNGQSALLQAVRQSIMKTYPTTSVGGDGQVYVIKFDDGITFEILPVFVNTSNTFTFADSNNGGSWKACDPRSEMQVFLARNKEVNGNLKAVARMMRIWKRHNSVPISGMLIDTLAFNFIQNWQYKDKSYLYHDFLVRDFLKYLSERDAQQAFWVAPGSGSRVYRIGNFQRPAAVAYQSALKAIENGTNNQFWARTQAWRSIFGSLYPD

SEQ ID NO: 5449 - protein, 293 aa, Rhizobium sullae
MGVAEDFRAFRNSYLIALDTIGSISYRYKRITKQLNKDFWSTDSETAHTLYVGSYGRDTAARGVSDLDVSFTLPNGLYATYNSYAGNGQSALLQAVRQSIMRTYPTTSIGGDGQVCVIKFDDGITFEILPVFVNTSDTFTFADSNNGGSWKACDPRSEMRVFLSRNKETNGNLKAIGRMMRVWKRHNNVPISGMLIDTHAYNFIQNWAHKDKSYLYHDFLVRDFLKYLSERDKQQAFWAAPGSGSRVYRSGNFERPAAVAYQSAIKAIENESNNQPWARTQAWRAIFGNLYPG

SEQ ID NO: 5450 - protein, 293 aa, Rhizobium phaseoli
MGVAEDFRAFRNNYLIPLETVSSISYRYKRITKQLNKDFWATDSETAHSLYVGSYGRDTAAKGVSDLDVAFTLPNTLYSTYNSYTGNGQSALLQAVRQSIMKTYPSTSIGGDGQVCVIRFDDGITFELLPVFVNTANTFTFADSNNGGTWKACDPRSEMQVFLARNKESNGNLKAVGRMMRIWKRHNAVPISGMLIDTLAFNFINSWEYKDKSYLYHDFLVRDFLKYLSERDIEQEYWSAPGSGSRVYRSGNFQRPAATAYQSALKAIQNETDNQLWARTQAWRSIFGSLYPG

SEQ ID NO: 5451 - protein, 293 aa, Rhizobium leguminosarum
MGVAEDFRAFRESYLIPLETVGSISYRYKRITKQLNKDFWQTDSETAHSLYVGSYGRDTAAKGVSDLDVAFTLPNSLYATCNSYTGNGQSALLQAVRQSIMKTYPSTSVGGDGQVCVIRFEDGITFEILPVFVNTANTFTFADSNNGGSWKVCDPRSEMQVFLARNKETNGNLKAIGRMMRIWKRHNAVPISGMLIDTLAFNFINSWEYKDKSYLYHDFLVRDFLKYLSERDTQQAYWSAPGSGSRVYRSGSFQRSAATAYQSALKAIQNETDNQLWARTQAWRSIFGSLYPG

SEQ ID NO: 5452 - protein, 293 aa, Rhizobium sophoriradicis
MGVAEDFRAFRDSYLIPLETVGSISYRYKRITKQLNKDFWQTDSETAHSLYVGSYGRDTAAKGVSDLDVAFTLPNSLYATYNSYTGNGQSALLQAVRQSIMKTYPSTSIGGDGQVCVIKFDDGITFEILPVFVNTANTFTFADSNNGGSWKACDPRSEMQVFLARNKETNGNLKAIGRMMRIWKRHNAVPISGMLIDTLAFNFINSWEYKDKSYLYHDFLVRDFLKYLSERDTQQAYWSAPGSGSRVYRSGNFQRPAATAYQSALKAIQNENDNQLWARTQAWRSIFGSLYPG

SEQ ID NO: 5453 - protein, 295 aa, Rhodovulum sulfidophilum
MSVADNFKSFRKIYLIPTEKISSISYRYKRITRQLNKDFWGTDSETSHSLYIGSFGRDTATNGVSDIDMSFTLPASLYHQYNAHSGNGQSTLLQKVKNSLNRTYSNSYTGADGQVVALNFTDSIKFEILPVFLNKDGKSFTFADTNGGGTWRVCNPRAEMEDFAIRNSATANGNLKAICRMARIWRDKHNVPMSGMLIDTLAYHWILGWKYRDKSFLYHDFLVRDFMKHLSEIDASKKYWRAPGSGSYVWKRGNFQAKAKVAYEKALDAIKYDADKPYTAANKWREIFGSKYPTP

SEQ ID NO: 5454 - protein, 295 aa, Paracoccus yeei
MGVAENFKAFRSGYLIPSETLSNISYRYKRITRQLNKDFWGTESETAHSLYVGSFGRDTATKGVSDIDMSFTLPSSIYHQYNAYSGNGQSTLLQKVKDSLNRTYANSYTGADGQVVALNFSDGITFEILPSFLNQDGKSFTFADTNGGGSWKVCNPRAEMDDFLLRNRVTANGNLKAICRMTRIWRDQHSVPISGMLIDTIAYQWIATWPYRDKSFLYHDFLVRDFMKHLSEIDTSKQYWRAPGSESYVWKKGNFQSKAKAAYEKALDAIKYDSDMPYTAASKWREIFGTKYPNP

SEQ ID NO: 5455 - protein, 293 aa, Sphingomonas sp.
MSVADNFRAFRANYLIPSATVSNISYRYKRITRQLNKDFWNTESETAHSLYVGSYGRDTAANGVSDLDVAFTLPNSVYQKYNGYAGNGQSALLQAVRDSIGRTYANSYVGADGQVVAINFTDGIRFEILPVFVNTENTFTFADTNNGGSWKVCDPRGEMSFFSARDSVTANGNLKAIGRMARIWRDRHSVPMSGMLIDTLAYQWISDWAHRDKSYLYHDYLVRDFMLYLSQIPSTQTYWRAPGSGSYVYKKGNFQTAAATAYQAALSAIDHEANERPATARNKWREIFGPTYP

SEQ ID NO: 5456 - protein, 294 aa, Sphingopyxis sp.
MSVSENFKAFRANYLIPMDMVNSISYRYKRMTKQLNRDFWSTDSETSHSLYVGSYGRDTAAKGVSDLDVAFTLPNTTYHKYDAYESNGQSALLQAVRTSIQKTYSITSIGGDGQVVVVAFDDGITFEILPVFLNDDGKTFTFPDSNGGGSWKICDPRGEMTAFAARDSVTANGNLKAICRMARIWRDRHNVPMSGMLIDTLAFQFIAGWAYKDKSFLYHDFLVRDFLFYLSQIDTAQTYWRAPGSGSYVWKKGNFQARAASAYDTAVSAIKHETDGYPMTARNKWREIFGSTYP

SEQ ID NO: 5457 - protein, 291 aa, Bacillus sp.
MSIASKFENLVKNTRTTNHDSVSERYKRITKRINLDFRGRDSNSLYSRYVGSYGRGTAIKGFSDVDMLIHLPDETYSKYNRYAEKGQSALLQAVRNSIRKTYPNTDVGGDGQVVVVKFSDGMMFEVVPAFIDKDGMSYIYPDSNGGGCWRTCNPVAEINAINQLNNKYNKNVKHLVRIMKAWRNENNVPISGMLLETLAMNFLTQYEYASKTYVYYDWMVRDFFKYLSEQNPEQSFWKAHGSGQPVWRRGNFEYKAKQGYLRTVEAIADEEKYPALANDTWRKIFGKCFTG

SEQ ID NO: 5458 - protein, 291 aa, Bacillus cereus
MSIASKFENLVKNTRTTNHDSVSERYKRITKRINWDFRGRDSNSLYSRYVGSYGRGTAIKGFSDVDMLIHLPDETYSKYNRYAEKGQSALLQAVRNSIRKTYPNTDVGGDGQVVVVKFSDGMMFEVVPAFIDKDGMSCIYPDSNGGGCWRTCNPVAEINAINQLNNKYNKNVKHLVRIMKAWRNENNVPISGMLLETLAMNFLTQYEYASKTYVYYDWMVRDFFKYLSEQNPEQSFWKAHGSGQPVWRRGNFEYKAKQGYLRTVEAIADEEKYPALANDTWRKIFGKCFTG

SEQ ID NO: 5459 - protein, 301 aa, Bacillus sp.
MIIFKGVGEHLSIASKFENLVKNTRTTNHDSVSERYKRITKRINLDFRGRDSNSLYSRYVGSYGRGTAIKGFSDVDMLIHLPDETYSKYNRYAEKGQSALLQAVRNSIRKTYPNTDVGGDGQVVVVKFSDGMMFEVVPAFIDKDGMSYIYPDSNGGGCWRTCNPVAEINAINQLNNKYNKNVKHLVRIMKAWRNENNVPISGMLLETLAMNFLTQYEYASKTYVYYDWMVRDFFKYLSEQNPEQSFWKAHGSGQPVWRRGNFEYKAKQGYLRTVEAIADEEKYPALANDTWRKIFGKCFTG

SEQ ID NO: 5460 - protein, 291 aa, Bacillus cereus
MSIANKFENLVKNTRTNNHNTVSERYKRITKRINLDFRGIDSDLLYSKYVGSYGRGTAIKGFSDVDMLVHLPYETYSKYNKYAEKGQSALLQEVRNSIRKTYPNTDVGGDGQVVVVKFSDGIMFEVVPAFINKDGISYTYPDSNNGGRWKTCNPVAEINAINQLNNKYNKNVKYLVRIMKAWRNENNVPISGMLLETLVMNFLIQYEYANKSYFYYDWMVRDFLKYLSQQNPEQSYWKAHGSGQQVWRKGNFEYKAKQGYLRAVEAIEDEEKYPSLANNTWRKIFGKCFIG

SEQ ID NO: 5461 - protein, 292 aa, Bacillus cereus
MGVAENFKAFTNNLRTTNHAIVSERCKRVTKRINLDFRGLDSSTSNSRYVGSYGRGTDIKGFSDVDILMVLSYDMYAKYNSYIGNGQSALLQAVRNSIKLTYPNTEIGGDGQVVVVNFSDGVKFEIVPAFLNEGGKSYTYADSNNGGSWKVCKPILEIEAINEQNKMYNKKVKHLVRMMKAWKNKNNVSISGLLIETLVMNFMKDWEHNDKSYIYYDWMARDFFKYLSECNPEQGYWLAWGSKQYVWRRGNFEYKAKQAYKTTLEAIEYDKKDYTYSAKEKWQEVFGKSYVG

SEQ ID NO: 5462 - protein, 292 aa, Bacillus cereus
MGVAENFKVFTNNLRTTNHAIVSERCKRVTKRINLDFRGLDSSTSNSRYVGSYGRGTDIEGFSDVDILMVLPYDMYAKYNSYIGNGQSALLQAVRNSIKSTYPNTEIGGDGQVVVVNFSDGVKFEIVPAFLNKGGKSYTYADSNNGGSWKVCKPILEIEAINEQNKMYNKKIKHLVRMVKAWKNKNNVSISGLLIETLVMNFMKDWEHNDESYIYYDWMARDFFKYLSECNPEQGYWLAWGSKQYVWRRGNFEYKAKQAYKTTLEAIEYDKKGYTSSAKEKWQEVFGKSYVG

SEQ ID NO: 5463 - protein, 292 aa, Bacillus thuringiensis
MGVSENFKTFTNNLRTTNHSIVSDRCKSITKRINLDFRRIDSATLNSRYVGSYGRGTSIKGFSDVDILMVLPFDTYKKYNSYVGNGQSALLQAVRNSIKLTYPNTEIGGDGQVVVVNFSDGIKFEIVPAFLKDEGESYIYADSNNGGSWKVCKPIIEILAINEQNKMYNKKVKHLVRMMKAWKNKNNVPISGLLIETLVMNFMKDWEHNDKSYTYYDWMVRDFFNYLSNCNPKQEYWLAWGSKQYVWRRGNFEYKAKQAHKTTTEAIECDGKGYTFSAREKWQEVFGKSYMG

SEQ ID NO: 5464 - protein, 292 aa, Alphaproteobacteria bacterium
MSVADWFQTFHANLAITNGDDISYRYKRITGRLNTDFRNTTSDTANSIYVGSYGRDTAIGKISDLDMAYQLPVALYDQYRAHSGNGPSALLQAVRTSVRNTYGTTDISADGQVLVINFSDNVKFEILPCFPHADGSSFIYPDSNAGGSWKVSNPRAEIAAIKNRNDTTNRNLKRLCRMMRVWKDRWDVPMGGLLIDTLAYGFILNWEHKDKSFLYYDWMCRDFFKFMADGDRNTNSWPAPGSRRAVTRSGLFEYKARMAENVAKEAIAYDSKQQHPSAKTKWREIFGPSFPA

SEQ ID NO: 5465 - protein, 426 aa, Desulfovibrio sp.
MLLPDAFKAFKEKLSINTELRQSISKKYCGITEALNDSFRCISSSTAYSLQVGSFGRHTAIKSISDLDMVYILPDELRSEYKDSPEKILYKTRDILVKKYPKTNIRSDRLVVCVHFLKCYVEVQPVFEIYDKNDSLSYFEYPDTYKQSWKKTKPRHEIHACKYKNDETCGNYYNICKMIRAWKNNFGIKIGGLLIDTLVYNFFSQDTFKEKYCTCSFDIYDQLLKDFFFYLKNQSNNSYYHAPGSNQQVRIKEKFIKKAEEAYNIIDTDKNCWKKIFGRYFPQMESLFCSSVHYRDTEEFIEDYYPVEIKGEVSITAVVSANGFRPRTYTKSASISSVYKKVKASITFSISTNINHPYTVKWKILNRGDEAKARDCIRGQIITSGAERKEPLTFLGNHYVECYIIQDEIVIARDRFYVNIEENLDK

SEQ ID NO: 5466 - protein, 142 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGS

SEQ ID NO: 5467 - protein, 362 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWK

SEQ ID NO: 5468 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSSTSENSRNLAWKKVFGRPFPNYTTKALSNVNVSEQFIEDQYEMNLYGHVSIECEIRKNNLLEALLSNLLGGGHDISTNRKLRFYVDEINNISHPYKIKWKIKNVGDEAERRGNVRGEILDDEGGSERFETADFSGPHFVECYVIYGNQVVARERIDVPIHN

SEQ ID NO: 5469 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPGAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5470 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSSTSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5471 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5472 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVIGEILDDEGGSERFETADFSGPHFVECYVIYGNQVVARDRIDVPIHN

SEQ ID NO: 5473 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSVKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5474 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSSTSENSRNLAWKKVFGRPFPNYTTKALSNVNVSEQFIEDQYEMNLYGHVSIECEIRKNNLLEALLSNLLGGGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5475 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIEDQYEMNLYGHVSIECEIRKNNLLEALLSNLLGEGHDISTNRKLRFYVDEINNIFHPYKIKWKIKNVGDEAERRGNVRGEILDDEGGSERFETADFSGPHFVECYVIYGNQVVARDRIDVPIHN

SEQ ID NO: 5476 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSSTSENSRNLAWKKVFGRPFPNYTTKALSNVNVSEQFIEDQYGMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5477 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKSLSNVNVSEQFIEDQYEMNLYGHVSIECEIRKNNLLEALLSNLLGEGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5478 - protein, 423 aa, Citrobacter werkmanii
MSTATDFKTLLDNIKIDNAGQISKRYGRITKALNQYFYNLDSKTANSLQVGSYGRFTGIRGISDLDMLYFLPATSWPRFRDRQSYLLQVVKTEIKKIFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKSLSNVNVSEQFIEDQYEMNLYGHVSIECEIRKNNLLEALLSNLLGEGHDISTNRKLRFYVDEINNISHPYKIKWKIKNVGDEAERRGNFRGEILDDEGGSERFETADFSGPHFVECYVIYGNQVVARDRIDVPIHN

SEQ ID NO: 5479 - protein, 423 aa, Klebsiella pneumoniae
MSTATDFKTLLDNIKIDNAGQISKRYGRITKALNQYFYNLDSKTANSLQVGSYGRFTGIRGISDLDMLYFLPATSWPRFRDRQTYLLQVVKTEIKKIFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTKKSLSNVNVSEQFIEDQYEMNLYGHVSIECEIRKNNLLEALLSNLLGEGHDISTNRKLRFYVDEINNISHPYKIKWKIKNVGDEAERRGNFRGEILDDEGGSERFETADFSGPHFVECYVIYGNQVVARDRIDVPIHN

SEQ ID NO: 5480 - protein, 423 aa, Klebsiella pneumoniae
MSTATDFKTLLDNIKIDNAGQISKRYGRITKALNQYFYNLDSKTANSLQVGSYGRFTGIRGISDLDMLYFLPATSWPRFRDRQSYLLQVVKTEIKKIFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTKKSLSNVNVSEQFIEDQYEMNLYGHVSIECEIRNNNLLEALLSNLLGEGHDISTNRKLRFYVDEINNISHPYKIKWKIKNVGDEAERRGNFRGEILDDEGGSERFETADFSGPHFVECYVIYGNQVVARDRIDVPIHN

SEQ ID NO: 5481 - protein, 423 aa, Salmonella enterica
MSTATDFKTLLDNIKIDNAGQISKRYGRITKALNRYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGLLIDTLCYNFFSNLTEYDDKSFKSYDQLSLDFFTFLENEGDRVFYYAPGSRSKVSVKKSFNKVAKLTKEYCEEALSSTSENSRNLAWKKVFGRPFPNYTTKALSNVNVSEQFIEDQYEMNLYGHVSIECEIRKNNLLEALLSNLLGGGHDISTNRKLRFYVDEINNISHPYKIKWKIKNVGDEAERRGNVRGEILDDEGGSERFETADFSGPHFVECYVIYGNQVVARDRIDVPIHN

SEQ ID NO: 5482 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKSLSNVNVSEQFIEDQYEMNLYGHVSIECEIRKNNLLEALLSNLLGEGLDISTNRKLRFYVDEIKNIPQPYRIKWKIKNEGSEAERRGNLRGEILDDKGNSEHFESADFSGPHFVECYVIHGNQVVARDRIDVPIHN

SEQ ID NO: 5483 - protein, 315 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYEEALSATSENSRNLAWKKVFGRPFPNYTTKALSNVNVSEQFIEDQYEMNLYGHVSIECE

SEQ ID NO: 5484 - protein, 423 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFGNEDGTFTYPDTHDGGSWKECNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKSLSNVNVSEQFIEEQYELNLYGHVSIECEIRNNNLLEALLSNLLGEGHDISTNRKLRFYVDEINNIPHPYKIKWKIKNVGDEAERRGNCRGQILDDEGDFERLETADFSGPHFVECYVIHGNQVVARDRIDVPIHN

SEQ ID NO: 5485 - protein, 301 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLENEGDRVFYYAPGSRSKVSVKKSFNKVAKLTKEYCEEALSATSENSRNLAWKKVFGRPFPNYTTKALSNVNVSEQFIED

SEQ ID NO: 5486 - protein, 423 aa, Escherichia coli
MSTATDFKTLLDNIKIDNAGQISKRYGRITKALNQYFYGIDSKTANSLQVGSYGRFTGIRGISDLDMLYFIPATEWSRFRDRQSYLLQVVKTEIKKAYKNTDIRGDGQVVVVKFKNQEVEIVPVFCNEDGTFKYPDTHDGGSWKTCNPRAEMSSFRTLNDDRKGHLRRLSKMVRAWKARHEVEISGFLIDTLCYKFFSNLSEYDDKSFKSYDQLSLDFFTFLENEGDRAFYYAPGSHSKVIVKKSFNKVAKLTREYCEEALSATGENSKNVAWKKVFGRSFPNYTAKSLSAVNVSEQYIEEQYELNLYGHVSIECEVRKNNLLEALLSNLLGEGLDISTNRKLRFYVDEINNIPHPYKIKWKIKNIGDEAERRGNFRGEILDDEGDSERFETADFSGPHFVECYVIHGNQVVARDRIDVPIHN

SEQ ID NO: 5487 - protein, 423 aa, Citrobacter freundii
MSTATDFKTLLDNIKIDNAGQISKRYGRITKALNQYFYDIDSKTANSLQVGSYGRFTGIRGISDLDMLYFLPATEWSRFRDRQSYLLQVVKTEIKKAYKNTDIRGDGQVVVVKFKNQEVEIVPVFCNEDGTFKYPDTHDGGSWKTCNPRAEMSYFRTLNDNRKGHLRRLSKMVRAWKARHEVEISGFLIDTLCYNFFSNLSEYDDKSFKSYDQLSLDFFTFLESEGDRAFYYAPGSHSKVIVKKSFNKVAKLTREYCEEALSATGENSRNVAWKKVFGRPFPNSTTKSYSAVNLSEQYIEEQYELNLYGHVSIECEVRKNNLLEALLSNLLGEGLDISTNRKLRFYVDEINNIPHPYKIKWKIKNIGDEAERRGNFRGEILDDEGDSERFETADFSGPHFVECYVIHGNQVVARDRIDVPIHN

SEQ ID NO: 5488 - protein, 423 aa, Pectobacterium parmentieri
MSTATDFKTLLDNIKIDNAGQISKRYGRITKVLNQYFYDIDSKTANSLQVGSYGRFTGIRGISDLDMLYFLPATEWPRFRDKQSYLLQVVKTEIKKAYKNTDIRGDGQVVVVKFKNQEVEIVPVFCNEDGSFKYPDTHDGGSWKICNPRAEMSSFRILNDDRKGHLRRLSKMVRAWKTRHEVEISGFLIDTLCYKFFSNLSEYNDKSFKSYDQLSLDFFTFLENEGDRAFYYAPGSHSKVIVKKSFNKVAKLTREYCEEALSATSENSRRVAWKKIFGRPFPNSTTKSLSAVNVSEQYIEDQYELNLYGHVSIECEIRKNNLLEALLSNLLGEGHDISTNRKLRFYVDEINNIPHPYKIKWKIKNIGDEAERRGNFRGEILDDEGYSERFETADFSGPHFVECYVIHGNQVVARDKIDVPIHN

SEQ ID NO: 5489 - protein, 422 aa, Serratia fonticola
MSTSADFKTLVDNIKIDNAGQISKRYGRITKSLNQYFYNIDSKVANSLQVGSYGRFTGIRGISDLDMLYFLPATEWSRFRDRQSYLLQVVKTEIKKAYKNTDVRGDGQVVVVKFKNQEIEVVPVFCNEDGTFKYPDTHDGGSWKVCNPRAEMASFRELNDDRKGHLRRLSKMIRAWKARHEVEISGFLIDTLSYKFFSNLEEYDDKSFKSYDQLTLDFFTFLVNEGDREFYYAPGSRSRVTVKKSFNKVAKLTKEYCEEALSATSENSRNIAWKKIFGRPFPNSETKSFSGLNISEEYIEDQYEMNLYGHVSIECEIRKNNLLEALLSNLLGEGNEINGNRKLRFYVDEINVPHPYEIKWKIKNVGEEAERLGNLRGGILDDEGGSERFETAEFSGPHFVECYVIFDNQVVARDRIDVPIHN

SEQ ID NO: 5490 - protein, 165 aa, Salmonella enterica
ATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRR

SEQ ID NO: 5491 - protein, 223 aa, Salmonella enterica
MSTATDFKTLLDNIKIDNAGQISKRYGRITKALNQYFYNLDSKTANSLQVGSYGRFTGIRGISDLDMLYFLPATAWPRFRDRQSYLLQVVKTEIKKTFKNTDIRGDGQVVVVKFKNQEVEVVPVFSNEDGTFTYPDTHDGGSWKVCNPRAEMSSFRALNDDRKGHLRRLSKMIRAWKARHEVEISGFLIDTLCYNFFSNLTEYDDKSFKSYDQLSLDFFTFLE

SEQ ID NO: 5492 - protein, 422 aa, Cronobacter sakazakii
MSTAADFKGLLDNIKIDNAGQITKRYGRITKALNEYFYDIDSKTANSLQVGSYGRFTGIRGISDLDMLYFLPAKDWSRFRDNQSYLLQVIKKEIKKAYKNTDIRGDGQVVVVNFKNQVVEVVPVFCNEDGTFKYPDTNNGGSWKECNPRGEMLAFRELNDYRKGHLRRLAKMVRAWRARHEVEISGFLIDTLCYNFFSTLIEYDDKSYKSYDKLSLDFFTFLAKEGDKSFYYAPGSNSKVWVKKSFNKVATLTKEYCEEAISATDEKARNLAWKKVFGRPFPNVSTIALSTTKNSEQFIEDQYEMNLWAHVSIECEISKNNLLEALLSNLLGEGNEVSKNRKLRFYVDEINAPYPYKIKWKIKNVGDEAERLGNLRGQILDDEGKSERLETADFSGPHFVECYVIHNNEVIARDRIDVPIHH

SEQ ID NO: 5493 - protein, 422 aa, Vibrio sp.
MTVSSNFEALLSNLQIKNKGQIGKRYRSITRALNREFRDSESKTANSKQVGSYGRKSGINGISDLDMLYVLPDSERQRFKNNPSYLLQVVRNAIRQVYKNTDIRGDGQVVVVKFKDYAEFEVCPVFLESDGRYKYPDSNDGGTWRKCNPNAELNAFKELNETRKGHLRYLSKMVRAWKNRNDVSMSGFLIDTLCYRFLQNNSDYDMCSFGSFDQLSLDFFTYLENEGEPNSYRAFGSLSKIPVKQSFHRAAKLARETCEAAISATTESEERKEWKKLYGRPFPSQSTVQKATSRPSGEQFIEDMYHNNPLYEITIECDVKKETITHKLSQLLGSTSSLNKGYDLSFRVEYHDIPVDFDLKWKVKNEGDQAIKKNCLRGQILDDDGTLSRKESTTFEGEHYVECYAIVNNTVVARDRITVPIS

SEQ ID NO: 5494 - protein, 422 aa, Vibrio vulnificus
MTVSTDFKTLLNNLQIKNRGQIGKRYRSITRALNLKFRGNDSKTSYSKQVGSYGRKSGIHGISDLDMLYELHSDDWKRFEHNPSYLLQVVRGAIREVYKKTEVRGDGQVVVVTFKDKAKFEICPVFRQDDGRYKYPDSNNGGSWPKCNADAELLAFRELNTLRKGHLRRLSKMVRAWKERNDVSMSGFLIDTLCYKFFKNNSDFDEKSYASYDQLSLDFFSFLEKEGTPDYYKAFGSMSKVPVKKSFHRVAKAAREMCEIAMQASSEAEMRKEWKKVYGKPFPSHSVNENLPAAKGEQFIEHTYPDSELKYEISIECDVRKDTITHKLSRLLGSDSPLNKGFNLNFHVDYHNIPDPFELKWKVKNEGEQALKQGCLRGEITDDDGSLSRTESTSFEGDHYVECYAIQNKKVVARDRILVPIA

SEQ ID NO: 5495 - protein, 422 aa, Vibrio sp.
MTVSTDFKTLLNNLQIKNRGQIGKRYRSITRALNLKFRGNDSKTSYSKQVGSYGRKSGIHGISDLDMLYELHSDDWKRFEHNPSYLLQAVRGAIREVYKKTEVRGDGQVVVVTFKDKSKFEICPVFRQDDGRYKYPDSNKGGSWPKCNTDAELLAFRELNTLRKGHLRRLSKMVRAWKERNDVSMSGFLIDTLCYKFFKNNSDFDEKSYASYDQLSLDFFSFLEKEGTPDYYRAFGSMSEVPVKKSFHRVAKAAREMCEIAMQASSEAEMRKEWKKVYGKPFPSHSVNENLPAAKGEQFIEHTYPDSELKYEISIECDVRKDTITHKLSRLLGSDSPLNKGFNLNFHVDYHDIPDAFELKWKVKNEGEQALKQGCLRGEITDDDGSLSRTESTSFEGDHYVECYAIQNKKVVARDRILVPIA

SEQ ID NO: 5496 - protein, 414 aa, Vibrio sp.
MFLDNLKIKSKDTISSRYGSITKNLNEKFRDLENDKKNYSLQAGSYGRYSGINGISDLDMLYILPPSAWTTYRKDPSKALDQTKDAIKKTYNTSKVKKDRNVVVVEMQDFTFEVVPVFEWQGVFKYPDTYNGGSWRKCDTRSELRAFKELNDNRKDNLRKLAKMIRAWKARNDIQMSGFLIDTLCYNFFKDNTKYDKSSFGSFDKMVKDFFQYLTKEPNKAFYYAFGSNSKVSVKKAFQADAQKALDNAIEAIEARENGYEDKCNQRYKAIFGTKFPNREAKQVSAVNEEFIEELFDMDITNQIVIDCNVKSDLITKMLSSLTFGGGERIQHQWKLHFFVKQTDIVGDYEVKWKVRNRGCVADRDKNHRGQIIDDDGSKTRDETATFYGDHTVECYAMRNNTVIARHEITVPIA

SEQ ID NO: 5497 - protein, 421 aa, Vibrio parahaemolyticus
MTVRRDFSVFLDNLKIKSKDTISSRYGSITKNLNEKFRDLENDKKNYSLQAGSYGRYSGINGISDLDMLYILPPSAWTTYRKDPSKALDQTKDAIKKTYNTSKVKKDRNVVVVEMQDFTFEVVPVFEWQGVFKYPDTYNGGSWRKCDTRSELRAFKELNDNRKDNLRKLAKMIRAWKARNDIQMSGFLIDTLCYNFFKDNTKYDKSSFGSFDKMVKDFFQYLTKEPNKAFYYAFGSNSKVSVKKAFQADAQKALDNAIEAIEARENGYEDKCNQRYKAIFGTKFPNREAKQVSAVNEEFIEELFDMDITNQIVIDCNVKSDLITKMLSSLTFGGERIQHQWKLHFFVKQTDIVGDYEVKWKVRNRGCVADRDKNHRGQIIDDDGSKTRDETATFYGDHTVECYAMRNNTVIARHEITVPIA

SEQ ID NO: 5498 - protein, 421 aa, Vibrio natriegens
MTVRRDFSVFLDNLKIKNKDTISSRYGSITKNLNEKFRDLENDKKNYSLQAGSYGRYSGINGISDLDMLYILPPSAWTTYRKDPSKALDQTKDAIKKTYNTSKVKKDRNVVVVEMQDFTFEVVPVFEWQGVFKYPDTYNGGSWRKCDTRSELRAFKELNDNRKDNLRKLAKMIRAWKARNDIQMSGFLIDTLCYNFFKDNTKYDKSSFGSFDKMVKDFFQYLTKEPNKAFYYAFGSNSKVSVKKAFQADAQKALDNAIEAIEARENGYEDKCNQRYKAIFGTKFPNREAKQVSAVNEEFIEELFDMDITNQIVIDCNVKSDLITKMLSSLTFGGERIQHQWKLHFFVKQTDIVGDYEVKWKVRNRGCVADRDKNHRGQIIDDDGSKTRDETATFYGDHTVECYAMRNNTVIARHEITVPIA

SEQ ID NO: 5499 - protein, 421 aa, Vibrio parahaemolyticus
MTVRRDFSVFLDNLKIKNKDTISSRYGSVTKNLNEKFRDLENDKKNYSLQAGSYGRYSGINGISDLDMLYILPPSAWTTYRKDPSKALDQTKDAIKKTYNTSKVKKDRNVVVVEMQDFTFEVVPVFEWQGVFKYPDTYNGGSWRKCDTRSELRAFKELNDNRKDNLRKLAKMIRAWKARNDIQMSGFLIDTLCYNFFKDNTKYDKSSFGSFDKMVKDFFQYLTKEPNKAFYYAFGSNSKVSVKKAFQADAQKALDNAIEAIEARENGYEDKCNQRYKAIFGTKFPNREAKQVSAVNEEFIEELFDMDITNQIVIDCNVKSDLITKMLSSLTFGGERIQHQWKLHFFVKQTDIVGDYEVKWKVRNRGCVADRDKNHRGQIIDDDGSKTRDETATFYGDHTVECYAMRNNTVIARHEITVPIA

SEQ ID NO: 5500 - protein, 421 aa, Vibrio vulnificus
MTVRRDFSVFLDNLKIKNKDTISSRYGSITKNLNEKFRNLENDKKNYSLQAGSYGRYSGINGISDLDMLYILPPSAWTTYRKDPSKVLDHAKDAIKKTYNTSKVKKDRNVVVVEMQDFTFEVVPVFEWQGVFKYPDTYSGGSWRKCDTRAELRAFKELNDKRKDNLRKLAKMIRAWKARNDIQMSGFLIDTLCYNFFKDNTKYDKSSFGSFDKMVKDFFQYLTKEPNKAFYYAFGSNSKVSVKKAFQADAQKALDNVIEAIEARENGYEDKCNQRYKAIFGTKFPNREAKQLSAVNEEFIEEVFDMDITNQIVIDCHVKSDLITKMLSSLTFGGERIQHQRKLHFFVKQTDIVGDYEVKWKVRNRGYIADRDKSHRGQIIDDDGSKTRDETATFYGDHTVECYAMRNNTVIARHEITVPIE

SEQ ID NO: 5501 - protein, 421 aa, Vibrio parahaemolyticus
MTVRRDFSVFLDNLKIKNKDTISSRYGSITKNLNEKFRGLENDKTSHSLQAGSYGRYSGIQGLSDLDMLYILPPSSWTTYRKDPSKALDHAKDAIKKTYKTSNVKKDRNVVVVEIQDFTFEVVPVFEWQGVFKYPDTYNGGSWRKCNTRAELLAFRELNNKRKDNLRKLAKMIRAWKARNEIQMSGFLIDNLCYNFFKENTQYDKARFGSFDKMVRDFFQYLTKEPNRAFYYAFGSNSKVGVKKSFQADAAIALYNANEAIEARENGYEDKCNQKYKAIFGTKFPHRETKQASAINEEFIEELFDMDRTNQIVIDCEVKSDLMTKMLSSLKFVGERIPHQRKLYFFVKQTDIVGDYEVKWKVRNRGHIADKNKDHRGEIIDDDGSKIHVETAIFHGDHTVECYAIRNNTVIARHEITVPIE

SEQ ID NO: 5502 - protein, 421 aa, Vibrio parahaemolyticus
MTVRRDFSVFLDNLKIKNKDTISSRYGSITKNLNEKFRGLENDKTSHSIQAGSYGRYSGIQGLSDLDMLYILPPSSWTTYRKDPSKALDHAKDAIKKTYKTSNVKKDRNVVVVEIQDFTFEVVPVFEWQGVFKYPDTYNGGSWRKCNTRAELLAFRELNNKRKDNLRKLAKMIRAWKARNEIQMSGFLIDNLCYNFFKENTQYDKARFGSFDKMVRDFFQYLTKEPNRAFYYAFGSNSKVGVKKSFQADAAIALYNANEAIEARENGYEDKCNQKYKAIFGTKFPHRETKQASAINEEFIEELFDMDRTNQIVIDCEVKSDLMTKMLSSLKFVGERIPHQRKLYFFVKQTDIVGDYEVKWKVRNRGHIADKNKDHRGEIIDDDGSKIHVETAIFHGDHTVECYAIRNNTVIARHEITVPIE

SEQ ID NO: 5503 - protein, 421 aa, Photobacterium damselae
MTVRRDFSLFLDNLKIKNKDSISSRYGTITKNLNEKFRGLENDKTNNSLQAGSYGRYSGIQGISDLDMLYILPPWAWNTYRKDPSKALDHAKDAIQQTYKTSKVRKDRNVVVVEMQDFTFEVVPVFEWQGVFKYPDTYNGGLWRKCNTRAELEAFRGLNTERKDNLRKLAKMVRAWKHRNDIQMSGFLIDTLCYNFFKDNTDYDKASFGSFDKMVRDFFQYLTKEPKKAYYYAFGSNSQVGVKKAFQADAEIALNNAIEAIEAREGGYEDKCNQRYKAIFGTKFPNREAKEVSAVNEQFIEELFDLDITNQIVIDCEIKSDLMTRMLSSLKFGGERIQHQRKLHFFVKQTDIGGDYEVKWKVRNRGYEADRQKNHRGDIMDDDGSKTRIETANFFGDHTVECYAIRDDRVIARHEITVPIE

SEQ ID NO: 5504 - protein, 421 aa, Vibrio vulnificus
MTVRRDFSVFLDNLKIKNKNKISSRYESITKNLNEQFRGLENDKTSYSLQAGSYGRYSGIQGISDLDMLYILPPSTWPTYRKDPSKALDHAKDAIKKTYKTSKVKKDRNVVVVEMQDFTFEVVPVFEWQGVFKYPDTYNGGLWRKCNTRAELQAFRELNTERKDNLRKLAKMIRAWKARNDIQMSGFLIDTLCYNFFKDNTDYDKASFGSFDKMVRDFFQYLTKEPEKTYYYAFGSNSQVGIKKAFQADAQIALENAIEAIEARESGYEDKCNQRYKAIFGTKFPNREAKQAAAVNEQFIEELFDLDITNQIIIDCEVKSDLMTRMLSSIKFVGERIQHQRKLHFFVKQTDIGEDYEVKWKVRNRGDEADKLRNHRGEIMDDDGSKTRIETANFYGDHTVECYAIRNNTVIARHEITVPIE

SEQ ID NO: 5505 - protein, 421 aa, Vibrio campbellii
MTVRRDFSVFLDNLKIKNKNKISSRYESITKNLNEQFRGLENDKTSYSLQAGSYGRYSGIQGISDLDMLYILPPSTWPTYRKDPSKALDHAKDAIKKTYKTSKVKKDRNVVVVEMQDFTFEVVPVFEWQGVFKYPDTYNGGLWRKCNTRAELQAFRELNTERKDNLRKLAKMIRAWKARNDIQMNGFLIDTLCYNFFKDNTDYDKASFGSFDKMVRDFFQYLTKEPEKTYYYAFGSNSQVGIKKAFQADAQIALENAIEAIEARESGYEDKCNQRYKAIFGTKFPNREAKQAAAVNEQFIEELFDLDITNQIIIDCEVKSDLMTRMLSSIKFVGERIQHQRKLHFFVKQTDIGEDYEVKWKVRNRGGEADKLRNHRGEIMDDDGSKTRIETANFYGDHTVECYAIRNNTVIARHEITVPIE

SEQ ID NO: 5506 - protein, 421 aa, Vibrio vulnificus
MTVRRDFSVFLDNLKIKNKNKISSRYESITKNLNEQFRGLENDKTSYSLQAGSYGRYSGIQGISDLDMLYILPPSTWPTYRKDPSKALDHAKDAIKKTYKTSKVKKDRNVVVVEMQDFTFEVVPVFEWQGVFKYPDTYNGGLWRKCNTRAELQAFRELNTERKDNLRKLAKMIRAWKDRNDIQMSGFLIDTLCYNFFKDNTDYDKASFGSFDKMVRDFFQYLTKEPEKTYYYAFGSNSQVGIKKAFQADAQIALKNAIEAIEARESGYEDKCNQRYKAIFGTKFPNREAKQAAAVNEQFIEELFDLDITNQIIIDCEVKSDLMTRMLSSIKFVGERIQHQRKLHFFVKQTDIGEDYEVKWKVRNRGGEADKLRNHRGEIMDDDGSKTRIETANFYGDHTVECYAIRNNTVIARHEITVPIE

SEQ ID NO: 5507 - protein, 419 aa, Unknown
  Description of Unknown: Pseudoalteromonas sequence
MTTRRDFSVFLDNLKIKKKDTISSRYGSITKNLNEKFRNLENDKKSYSLQAGSYGRYSGIQGISDLDMLYILPPSSWPTYRKDPAKALDHAKDAICKTYKTSKVRKDRNVVVVEMQDFTFEVVPVFEWNGIFKYPDTYTGGSWRKCDTRAELQTFKELNKERKDNLRKLAKMIRAWKFRNNIQMSGFLIDTLCYNFFNGNNLYDNTSFGGFDKMLAGFFEFLSKEPVKDFYYAFGSNSRVYVKKAFQNDAGTALDNVNEAIQARVDGHEEKCNQRYKSIFGTKFPNREAKQVSAINEQFIEELFDMDITNQIVIDCEVKSDLITKMLSKLGGARIQPERKLHFYIKQTDIVEDYEVKWKVRNYGLIADRDKNHRGNIMNDNGSKTLVETSSFYGDHTVECYAISNNTVIARHQITVPIE

SEQ ID NO: 5508 - protein, 421 aa, Vibrio parahaemolyticus
MTVYRDFSLFLDNLKIKNKDTISSRYGSITKNLNEKFRCLANDKSNYSLQAGSYGRYSGIKGISDLDMLYIIPSDSWTIYRKDPSKALDHAKTAIQKTYKNSSIRKDRNVVVIEMQDFTFEVVPVFEWQGVFKYPDTYNGGQWRKCNTRAELRAFRELNNERNDNLRKLAKMTRAWKARNNVKMSGFLIDTLCYRFFTNNGNYDNASFGSFDRMVKDFFEFLSNEPKKNFYYAFGSNSKVYVYQPFQKAAKEALEAAETAIDARAKGQDAKCNQCYKSIFGTKFPNREMTQIKAAQEQFIEDLFPMDLTNKIEIDCEVKDDLITRMLSTIRLGGGRIQHERKLKFFVKGSDITEDYEVKWKVRNHGHEADRKKMHRGQIMDDDGSKIRVETATFYGDHTVECYAIRNNTVVARHEITVPIE

SEQ ID NO: 5509 - protein, 421 aa, Vibrio parahaemolyticus
MTVYRDFSLFLDNLKIKNKDTISSRYGSITKNLNEKFRGLANDKTNYSLQAGSYGRYSGIQGISDLDMLYIIPSDSWTTYRKDPSKALDHAKTAIQKTYKTSSIQKDRNVVVVEMQDFTFEVVPVFEWQGVFKYPDTYNGGQWRKCNTRAELQAFRELNNERNDNLRKLAKMTRAWKARNKVKMSGFLIDTLCYRFFTNNDNYDNASFGSFDKMVKDFFEFLSNEQNKKFYYAFGSNSKVYVYQPFQKAAKDALEAAEAAIDARAKGQDAKCNQCYKSIFGTKFPNREVTQIKAAQEQFIEDLFLMDLTNQIEIDCEVKDDLVTRMLSTIRFGGGRIQHERKLHFFVKGSDITEDYEVKWKVRNRGHEADRQKNHRGQIMDDDGSKIRVETATFYGDHTVECYAIRNNTVIARHEITVPIE

SEQ ID NO: 5510 - protein, 423 aa, Alteromonas macleodii
MTVYRDFSLFLDNLKIKKKDIISSRYESITRNLNEKFRGLDNEKTKFSLQAGSYGRYSGIRGISDLDMLYILPSDAWSKYRQDPAKALDHAKEAIEKTYKTTSIRKDRNVVVVTMNDFIFEVVPVFEWRGVFKYPDTYDGGKWRKCNTRAELREFKELNAERKDNLRKLAKMVRAWKSKNDVKMSGFLIDTLCYNFFNGNTEFDSKGFGSFDELICTFFSYLSNEPDRSYYYAFGSNSKVMVSKPFQEVAKEALENAEAAIEAREKGQEAKCNKCYKSLFGTKFPNREVKQARASTEQFIEELYPSMDVTDNYIEIDCQIKDDLVTKMLSTLRYNGGRIGHQRKLHFFVKDTNIIGDYEVKWKVRNRGPIADRDNSHRGQILDDDGTKIRVETASFQGDHTVECYAIRKDTVIARHQIAVPIE

SEQ ID NO: 5511 - protein, 421 aa, Vibrio caribbeanicus
MTVQSDFKSFLTNLQIKNAGQISGRYGSITRRLNMHFRDSESKTANSLQVGSYGRYTGIDGISDLDMLYIMPPSLWGTYKKDQSGLLDVCKEQIKKVYPQTETKKDRNVIVVSFSNYVIEVVPVFKLTNGKYYYPDTYNGGSWLVCDPKAELKEFKEKNKERNGNLRRLAKMVRAWRTRNNIEMSGFLIDTLCYRFIDKNEDFDNTSYGKYDVLVRDFFEFLENEPDKQYYLAPGSNSHVKVKKKFQSDAKAAREDCDEAITARAEAKADKCNRYYKSVFGRKFPNNTAVAKAETTEEFIEHKYEQDLKYNIALDCEVKTDVMTNFLSRMLDSKERILPERKLKFTAMNIDIVGDFELKWKVLNQGDIADRRNNIRGQIVDDDGTRTKTETADFYGDHLVECYALQNNVVVARDRIEVPIA

SEQ ID NO: 5512 - protein, 421 aa, Vibrio splendidus
MTVQSDFKSFLTNLQIKNAGQISKRYGSITRRLNMHFRDSENKTANTLQVGSYGRYTGIDGISDLDMLYIMPPSLWDTYKKDQAGLLDACKEQIKKVYPQTETKKDRNVIVVSFSNYVIEVVPVFKLINGKYYYPDTYNGGSWLVCDPKAELKEFKEKNEERNGNLRRLAKMVRAWKSRNNIEMSGFLIDTLCYRFIDKNEDFDNASYGKYDVLVRDFFEFLENEPDKQYYLAPGSNSHVKVKKKFQSDAKAAREDCDEAITARAEAKYDKCNRSYKSVFGRKFPNNTAVAKAETTEEFIEHKYEQDLKYNIVLDCEVKKDVVTRFLSRMLDSNERILPERKLKFTAMNIDIIGDFELKWKVLNQGDIAYKRSNIRGQIVNDDGTRTKTETADFYGDHVVECYALQNNVVVARDRIEVPIA

SEQ ID NO: 5513 - protein, 420 aa, Psychromonas sp.
MTIHSDFKSFLINLQIKEAGQISSRYGSITRRLNMHFRDTESRTSHSLQVGSYGRYTGIDGISDLDMLYIMPSTSWDLYKNDQSGLLDACKEQIRKTYPSTEIKKDRNVVVVRFAKFLIEVVPVFEQVGKKYKYPDTYKDGSWKICDPNAEMKAFKDKNSERNNNLRALARMVRAWRNRNNIEMSGFLIDTLCYRFITDNEGFDKSSYGKYDILVRDFFEFLSNEPVQSFYFAPGSNSKVKVKKNFQSNAETAKEACDNAISTRQEQKESMCTLHYRSVFGNKFPNAITVTKTTTEEFIQDKYTLNLKHRISLDCEIKNDSMTRFLSRLLNAKQKISQERQLKFIANNIDIIGEFKVEWKILNQGKFAEDNHKTRGEILDDDGSKTRNERSKFNGEHLVECYAIQNDVVVAREIIEVPIA

SEQ ID NO: 5514 - protein, 425 aa, Moritella sp.
MTIQADFQSFLNNLQIKNAGQISKRYGSITRRLNMFFRNGSENRTANSLQVGSYGRYTGISGISDLDMLYILPDSFLVTYKDNPYLALKHCKEQIQLVYGTSKVKVDRNVVVVTFKNYVIEVVPTFKTFDGRYLFPDTYGDGSWPICNPSAELRSFKDKNEQRNNNLRRLAKMVRAWRARAGINMSGFLIDTLCYRFLDNNTDFDNKSFGSYDILVRDFFSFLENEPDKAYYRAFGSFSQVNVYAKFQLKAKEARENCESAMQARVVGKESKCNLKYKAVFGKKFPVIDNEGVAKTTEEFIQTKHPVKLTNNITLDCEVKKDAMFEFLSKLHDQGLPILTNRKLKFSIADSDIFGPYELKWKVLNRGEEAERRKVIRGQIMDDKGSKTLEESADFSGDHYVECYAIQNGVVVARDRMDVPIIGEL

SEQ ID NO: 5515 - protein, 405 aa, Vibrio lentus
MNFDIAFRTLISNISIQNNDEIKTRYKKITKRLNKTFRDLDSDDRNCLAVGSYGRKSGVDKISDLDMLYKFPNSLKEKYKKNQGYFLQSVRTSILETYPSHKVRVDGQVVIVPFKNQDVEVVPCFEEADGTFTYADNNQGGKWRNCNPRAELKAFKELNDERNNKLRDLAKMVRAWKDQYGVKMSGFLIDTTTYRFLNNNNTYDGQGFSCYLSMFHSYLTFLQGLNVGSHLRAPGSLTTINIPQSNSRKILRALKICEESALKPELKRSFQLLKSVFGKHFPIPQSNTNKSFRNTEEYIDDIYNYDIYCDAGILLDCNVTQNGYQPRFLRDMNRLGLPLSTKNTLDFQVTLSEELLNIPHEIKWKVTNRGDIAEAKDCIRGQIIDDEGHSKRREVSSFSGDHRRC

SEQ ID NO: 5516 - protein, 431 aa, Campylobacter coli
MNVSNTFQEFLQNLAIDNKEEISNKYKEITKVLNIKYRNTESKTSNSLQVGSYGRFTAIKGISDLDMIYILPRTEYKRFKDHGQSALLQEVKKTIQSRYPKTDMRRDGQVVVISFTNYQIEVLPAFECKNGSFLYPDTNDGGSWKNTNPRLEIKAISDLHEKNKNLRNLCKMIRSWKNYHSVAMGGLLIDSLAYNFLNSTTYYNDKSFAHYDQLIKDFFKYLSDLQNTNYVFAPGSYQKVYIKSKFQTKAKKAHKLVLEAIEAQKNKNANQKWKKIFGRGFPSAVQLATEAMNESISAWTNTEEFIEDKYNVDIRYDLSIDCEVTQIGFRTDKLSNILAKNIRLLPNKELKFQIVHNDTKGDFEIYWKVLNRGDEAQKRNMIRGQIVKGTKVKKETTNFRGDHIVECYIVQNNTVVAKDRIHVPISEGIYS

SEQ ID NO: 5517 - protein, 431 aa, Campylobacter coli
MNISNTFQEFLQNLAIDNKEEISNKYKEITKVLNIKYRNTESKTSNSLQVGSYGRFTAIKGISDLDMIYILPRTEYKRFKDHGQSALLQEVKKTIQSRYPKTDMRRDGQVVVISFTNYQIEVLPAFECKNGSFLYPNTNDGGSWKNTNPRLEIKAISDLHEKNKNLRNLCKMIRSWKNYHSVAMGGLLIDSLAYNFLNSTTYYNDKSFAHYDQLIKDFFKYLSDLQNTNYVFAPGSYQKVYIKSKFQTKAKKAHKLVLEAIEAQKNKNANQKWKKIFGRGFPSAVQLATEAMNESISAWTNTEEFIEDKYNVDIRYDLSIDCEVTQIGFRTDKLSNILAKNIRLLPNKELKFQIIHNDTKGDFEIYWKVLNRGDEAQKRNMIRGQIVKGTKIKKETTNFRGDHIVECYIVQNNTVVAKDRIHVPISEGIYS

SEQ ID NO: 5518 - protein, 431 aa, Campylobacter coli
MNVSNTFQEFLQNLAIDNKEEISNRYKEITKVLNIKYRNTESKISNSLQVGSYGRFTAIKGISDLDMIYILPRTEYKRFKDHGQSALLQEVKKTIQSRYPKTDMRRDGQVVVISFTNYQIEVLPAFECKNGSFLYPDTNDGGSWKNTNPRLEIKAISDLHEKNKNLRNLCKMIRSWKNYHSVAMGGLLIDSLAYNFLNSTTYYNDKSFAHYDQLIKDFFKYLSDLQNTNYVFAPGSYQKVYIKSKFQTKAKKAHRLVLEAIEAQKNKNANQKWKKIFGRGFPSAVQLATEAMNESISAWTNTEEFIEDKYNVDIRYDLSIDCEVTQIGFRTDKLSNILAKNIRLLPNKELKFQIIHNDTKGDFEIYWKVLNRGDEAQKRNMIRGQIVKGTKIKKETTNFRGDHIVECYIVQNNTVVAKDRIHVPISEGIYS

SEQ ID NO: 5519 - protein, 431 aa, Arcobacter butzleri
MNVSSTFQEFLQNLAIDNKEEISNRYGEITKVLNIKYRNTESKTSNSLQVGSYGRFTAIKNISDLDMVYILPWTEYERFKNDRQSALLQEVKKTIQSRYPKTDVRGDGQVVVISFTNYQIEVLPAFENSDGSFLYPDTNNGGSWKTTKPRLEIKAISDLHQAKNQNLRTLCKMIRSWKNYHGVAMGGLLIDSVAYNFLNSTTYFDDKSFTYYDWLIRDFLKYLSDLQNTNHVFAPGSNQKVYIKKKFQTRAKKAHKLVLEAIEAQENKNANQKWKKIFGRNFPSAVQLTTEVMDKSIATWTNTEEFIEDKYNVDIRYDLSIDCEVTQAGFRTDNLLSILASKIRLLPNKELKFQIIHNDVKGDFEIYWKVLNRGDEAQKRNMIRGQIVKGSSIKKEKTNFRGDHIVECYIVQNNIVVAKDRIHVPISEGVY

SEQ ID NO: 5520 - protein, 270 aa, Propionibacterium freudenreichii
MKTAEIFDGLLSALKLGDTASVIASRRDEIAKALNKDFREKDGCSDYKLMVGSFGRHTAIKGVSDLDMIYILPPGIRDAYASDSGPRRMLERVRDDLKARYPSTDIRVDQCVVRVQFAANAFKFDVQPAFDNADGSFSYPDTKSESWKTTKPRDEIQATRECNLRTSTNMRHLARMARAWKNANGVVMGGLLIDTLVYRFFEQTREFDAVGTGSFDRMARDFFEFLKNEPEKGYYLALGSHQRVDVKAKFQPKATKAYNRCVEAMEADVG

SEQ ID NO: 5521 - protein, 435 aa, Propionibacterium freudenreichii
MKTAEIFDGLLSALKLGDTASVIASRRDEIAKALNKDFREKDGCSDYKLMVGSFGRHTAIKGVSDLDMIYILPPGIRDAYASDSGPRRMLERVRDDLKARYPSTDIRVDQCVVRVQFAANAFKFDVQPAFDNADGSFSYPDTKSESWKTTKPRDEIQATRECNLRTSTNMRHLARMARAWKNANGVVMGGLLIDTLVYRFFEQTREFDAVGTGSFDRMARDFFEFLKNEPEKGYYLALGSHQRVDVKAKFQPKATKAYNRCVEAMEADGASSANATWREVFGASVPLAESANDARSFKNTEEFIEDRYPVDISDTVSIDCDVTQDGWRPMKLREMLRTGTLLKADKRLRFTVVACSVPQPYTVKWKVLNRGPEAERRNNIRGQIVDPTASGVRTEHSDFRGEHIVECYIVKGGIVVARDRIDVPISTTSAHAASS

SEQ ID NO: 5522 - protein, 435 aa, Arcanobacterium haemolyticum
MKAAEIFNGLLSALKLGDTASVIASRRDEIAKALNKDFRGKDGCSDYRLMVGSFGRHTAIKGVSDLDMIYILPPDIRGDYAGDGGPRRMLERVRDDLKARYPNTDIRVDQCVVRVQFTANAFKFDVQPAFENAEGSFSYPDTKSDSWRITKPRDEIRATRESTARTSTNMRHLARMARAWKNANGVAMGGLLIDTLVYRFFEQSHVFDAVGTGSFDRMARDFFEFLKNEPEKDYYLALGSYQRVDVKAKFQPKAKKAYNRCVEAMEAEDTSSANATWREVFGTSVPLAKSSRDARSFKYTEEFIEDHYPVEISDTVSIDCEVTQDGWRPMKLREMLRLGTLLKSDRKLRFMVVACSVPQPYTVKWKVLNRGPEAERRNNIRGQIVDSTAAGVRSEYSDFRGDHLVECYIVKDGIVVARDRIDVPISTTSAHPPSV

SEQ ID NO: 5523 - protein, 436 aa, Cutibacterium avidum
MKAAEIFNGLLSALKLGDTASVIASRRDEIAKALNKDFRGKDGCSDYRLMVGSFGRHTAIKGVSDLDMIYILPPGIRGDYAGDGGPRRMLERVRDDLKARYPNTDIRVDQCVVRVQFTANAFKFDVQPAFDNADGSFSYPDTKSDSWRITKPRDEIRATRESTVRTSINMRHLARMARAWKNANGVAMGGLLIDTLVYRFFEQTHDFDAVGTGSFDRMARDFFEFLKNEPEKDYYLALGSYQRVDVKAKFQPKARKAYNRCVEAMKAEGTSSANATWREVFGTSVPLAKSSRDACSFKYTEEFIEDHYPVEISDTVSIDCEVTQDGWRPMKLREMLRLGTLLKADRKLRFMVVACSVPQPYTVKWKVLNRGPEAERRNNIRGQIVDSTAAGVRSEHSDFRGAHLVECYIVKDGIVVARDRIDVPISTTSGSSQMRV

SEQ ID NO: 5524 - protein, 435 aa, Unknown
  Description of Unknown: Rothia sequence
MKKAEIFDGLLSALKVGDTASVIASRRDEIAKALNRDFRKKDGCSDYNLMVGSFGRHTAIKGVSDLDMIYILPEGIREDYVGGRGPRRMLERVRDDLKARYPNTDIRVDQCVVRVQFAANAFKFDVQPAFENTDRSFSYPDTKSESWKITKPRDEIQATRESVARTSANMRHLARMARAWKNVNGVVMGGLLIDTLVYRFFEQTHEFDATGSGSFDRMVRDFFEFLKNEPERDYYLALGSHQRVYVKAKFQPKAKKAYNRCVEAMEAEGTSMADSIWRELFGTFVPRAKSLNDVRLFKNTEEFVEDRYPVDISETVSIDCKVTQDGWRPMKLREMLRTGTLLKADKKLRFMVVECSVPRPYTVKWKVLNRGPEAERRNSIRGQIVDSTVSGVRDERSDFQGEHLVECYIVKDGIVVARDRIDVPISTTSTRSSSS

SEQ ID NO: 5525 - protein, 435 aa, Rothia sp.
MKTAEMFDGLLSALKVGDTASVIASRRDEIAKALNKDFRKKDGCSDYNLMVGSFGRHTAIKGVSDLDMIYILPTGIREDYTGDSGPRRMLERVRDDLKARYPKTDIRVDQCVVRVQFAANAFKFDVQPAFENTDGSFSYPDTKSKSWKTTKPRDEIQAIRESVDRTSANMRHLARMARAWKNANGVVMGGLLIDTLVYHFFEQTHEFDAAGSGSFDRMARDFFEFLKNEPEKDYYLALGSHQRVYVKAKFQPKAKKAYNRCVGAIEAEGKSMANSIWREVFGTFVPRAKSPNDVRLFKNTEEFVEDRYPVDISETVSIDCRVTQDGWRPMKLREMLRTGTWLKVDKKLRFMVVECSVPQPYKVKWKVLNRGPEAERRNSIRGQIVDSTVSGVRDERSDFPGEHLVECYIVKDGIVVARDRIDVPISSTSTRSSSS

SEQ ID NO: 5526 - protein, 439 aa, Streptomyces ipomoeae
MTMKTSEIFETLLQNLKVGETATTVASRRDEITKALNKDFRDKDGCTDYKLMVGSFGRHTAIKGVSDLDMIFILPPGIRSSYEGDTGPRRILEKVRDDLKARYKNTEIRVDQCVVRVRFTSNAFKFEVQPAFENADGSFDYPDTKAEGWKVTKPREEIAATKECNDRTSTNMRHLARMARAWKNANGVNMGGLLIDTLVYNFFDQTDDYDAAGTGSFDLMARDFFEFLKDQPEQEHYLALGSRQRVHVKAQFQPKAKKAYNRCLEAIADEGKASANKKWREVFGTSVPLAKSASESSRSFRDTEEFIEDEFPVDVSESVSIDCEVTQAGWRPAWLRAMRRGGILLKADKSLRFVVTSCSVGEPYTLKWKVLNRGPEAERRDEIRGQIVDSSKRGVRIEHSDFKGEHVVECYVVKDGVVVARDRIDVPIGNTSVKSVNIL

SEQ ID NO: 5527 - protein, 437 aa, Streptomyces ipomoeae
MKTSEIFETLLQNLKVGETATTVASRRDEITKALNKDFRDKDGCTDYKLMVGSFGRHTAIKGVSDLDMIFILPPGIRSSYEGDTGPRRILEKVRDDLKARYKNTEIRVDQCVVRVRFTSNAFKFEVQPAFENADGSFDYPDTKAEGWKVTKPREEIAATKECNDRTSTNMRHLARMARAWKNANGVNMGGLLIDTLVYNFFDQTDDYDAAGTGSFDLMARDFFEFLKDQPEQEHYLALGSRQRVHVKAQFQPKAKKAYNRCLEAIADEGKASANKKWREVFGTSVPLAKSASESSRSFRDTEEFIEDEFPVDVSESVSIDCEVTQAGWRPAWLRAMRRGGILLKADKSLRFVVTSCSVGEPYTLKWKVLNRGPEAERRDEIRGQIVDSSKRGVRIEHSDFKGEHVVECYVVKDGVVVARDRIDVPIGNTSVKSVNIL

SEQ ID NO: 5528 - protein, 439 aa, Streptomyces diastatochromogenes
MTMKTSEIFETLLENLKVGETATTVASRRDEITKALNKDFRDKDGCTDYKLMVGSFGRHTAIKGVSDLDMIFILPPGIRSSYDGDTGPRRILERVRDDLKARYKNTEIRVDQCVVRVRFTSNAFKFEVQPAFENAEGSFDYPDTKAEGWKVTKPREEIAATKECNDRTSTNMRHLARMARAWKNANGVNMGGLLIDTLVYNFFDQTDDYDAAGTGSFDLMARDFFEFLKDQPEQEYYLALGSRQRVHVKAQFQPKAKKAYNRCLEAIADEGKTSANKKWREVFGTSVPLAKSASESSRSFRDTEEFIEDEFPVDVSETVSIDCEVTQAGWRPTWLRAMRRGGILLKADKRLRFVVTSCSVGEPYTLKWKVLNRGPEAERRDKIRGQIVDSSKRGVRIEHSDFKGEHVVECYVVKDGVVVARDRIDVPVSNTSVKTANVS

SEQ ID NO: 5529 - protein, 439 aa, Streptomyces sp.
MKMKTSEIFETLLENLKVGDTATTVASRRDEITKALNKDFRDKDGCTDYKLMVGSFGRHTAIKGVSDLDMIFILPPGIRSSYDGDTGPRRILERVRDDLKARYKNTEIRVDQCVVRVRFASNAFKFEVQPAFENADGSFDYPDTKAEGWKVTKPREEIAATKECNDRTSTNMRHLARMARAWKNANGVNMGGLLIDTLVYNFFDQTDDYDAAGTGSFDLMARDFFEFLKDQSEQEYYLALGSRQRVHVKAQFQPKAKKAYNRCLEAIADEGKTSANKKWREVFGTSVPLAKSASESSRSFRDTEEFIEDEFPVDVSETVSIDCEVTQAGWRPTWLRAMRRGGILLKADKNLRFVVTSCSVGEPYTLKWKVLNRGPEAERRDAIRGQIVDSSKRGVRIEHSDFKGEHVVECYVVKDGVVVARDRIDVPIGNTSVKRANAL

SEQ ID NO: 5530 - protein, 437 aa, Streptomyces acidiscabies
MKTSEIFETLLQNLKVGETATTVASRRDEITKALNKDFRDKDSCTDYKLMVGSFGRHTAIKGVSDLDMIFILPPGIRSSYDGDSGPRRILERVRDDLKARYKNTEIRVDQCVVRVRFTSNAFKFEVQPAFENADGSFDYPDTKAEGWKVTKPREEIAATKECNDRTSTNMRHLARMARAWKNANGVNMGGLLIDTLVYSFFDQTDDYDAAGTGSFDLMARDFFGFLKDQPEQEYYLALGSRQRVHVRAQFQPKAKKAYNRCLEAIADEGKTSANKKWREVFGTSVPLAKSASESSRSFRDTEEFIEDEFPVYVSETVSIDCEVTQAGWRPTWLRAMRRGGFLLKADKSLRFVVTSCSVGEPYTLKWKVLNRGPEAERRDMIRGQIVDSSKRGVRIEHSDFKGEHVVECYVVKDGVVVAQDRIDVPVSNTNVKTANVL

SEQ ID NO: 5531 - protein, 439 aa, Streptomyces griseus
MTMETSEIFETLLKNLKVGETATTVASRRDEITKALNKDFRDKDGCTDYKLMVGSFGRHTAIKGVSDLDMIFILPPGIRSSYEGDTGPRRILERVRDDLKARYKNTEIRVDQCVVRVRFTSNAFKFEVQPAFENFDGSFDYPDTKAEGWKVTKPREEVAATKECNDRTSTNMRHLARMARAWKNANGVNTGGLLIDTLVYNFFDQTDDYDAAGTGSFDLMARDFFQYLKDQSEQEYYLALGSRQRVHVKAQFQPKAKKAYNRCLEAIADEGKTSANKRWREVFGTSVPLAKSASESSRSFRDTEEFIEDDFPVDVSETVSIDCEVTQAGWRPTWLCAMRRGGILLKADKGLRFVVTSCSVGEPYTLKWKVLNRGPEAERRNAIRGQIVDSSKRGVRIEHSDFKGEHVVECYVVKDGVVVARDRIDVPVGNTSVKRANAL

SEQ ID NO: 5532 - protein, 437 aa, Streptomyces sp.
METSEIFETLLNNLKVGETAMTVASRRDEITKALNKDFRDKDGCTNYKLMVGSFGRHTAIKGVSDLDMIFILPPRIRSSYDGDTGPRRILERVRDDLKARYKNTEIRVDQCVVRVRFTSNAFKFEVQPAFENDDGSFDYPDTNAEGWKVTKPREEIAATKECNDRSSTNMRHLARMTRAWKNANGVNMGGLLIDTLVYNFFDQTDDYDAAGTGSFDLMARDFFEFLKDQPEQEYYLALGSRQRVHVKAQFQPKAKKAYNRCLEAIADEGKTSANKKWREVFGTSVPLANSASASSRSFRDTEEFIEDEFPVDVSETVSIDCEVTQAGWRPTWLRAMRRGGMLLKADKGLRFVVTSCSVREPYTLKWKVLNRGPEAERRDAIRGQIVDSSKRGVRIEHSDFKGEHVVECYVVKDGVVVARDRIDVPIDNTSVKRANAL

SEQ ID NO: 5533 - protein, 439 aa, Streptomyces sp.
MTMKTSEIFETLLQNLKVGETATTVASRRDEITKALNKDFRDKDGCTEYKLMVGSFGRHTAIKGVSDLDMIFILPPGIRASYDGDTGPRRILERVRDDLKARYKNTEIRVDQCVVRVRFTSNAFKFEVQPAFENADGSFDYPDTKAGGWKVTKPREEIAATKECNDRTSTNMRHLARMARAWKNANGVNIGGLLIDTLVYNFFDQTDDYDAAGTGSFDLMARDFFEFLKDQPEQEYYLAVGSRQRVHVKAKFQPRARKAYNRCLEAIEDEGKTSANKKWREVFGTSVPLATRAIESSRSFRDTEEFIEDQFPVDVSETVSIDCEVTQAGWRPTWLREMRRDGTLLKANKRLRFVVTSCSVGEPYTMKWKVLNRGPEAERRDNIRGQIVDSSKQGVRTEHSHFKGEHVVECYVVKDGVVVARDRIDVPVSNTSVNTANVS

SEQ ID NO: 5534 - protein, 437 aa, Rhodococcus sp.
MKTSEIFDTLLANLKVGETAAAVAARRDEITKALNKDFRSKNACTDYKLMVGSFGRHTAIKGVSDLDMIFILPPGIRSGYSNETGPRRMLERVRDDLQARYPNTSVRVDQCVVRVQFTSNAFKFEVQPAFENANGSFDYPDTKANDWKPTKPRKEIAATKECNDRTSTNMRHLARMVRAWKNANGVNMGGLLIDTLVYNFFAQTTDYDSAGTGSFDLMARDFFAFLKDEPEQDYYLALGSRQRVNVKARFQPKAKKAYHRCLEAIEAEGKAAANKKWRDIFGTSVPLATTASEAARSYRNTEQFIEDRFPVDVTETVVIDCEVTQAGWRPTWLRAMRRGGLLLKADKSLRFVVTSCSVEEPYTLKWKVLNRGPEAERRDAIRGQIVESTRPNTRVEHSNFKGEHVVECYVVKDGVVVARDRIDVPISNTSIKESAGT

SEQ ID NO: 5535 - protein, 437 aa, Rhodococcus erythropolis
MKTSEIFDTLLTNLKVGETAAVVASRRDEITKSLNKDFRSKDACTDYKLMVGSFGRHTAIKGVSDLDMIFILPPGIRCDYSNETGPRRMLERVRDDLKARYPNTSVRVDQCVVRVQFTTNAFKFEVQPAFKNADGSFEYPDTKAEGWKLTKPRDEITATKECNDRTSTNMRHLARIVRAWKNANGVNMGGLLIDTLVYNFFAQTDDYDSAGTDSFDLMARDFFAFLKDEPEQDYYLALGSRQRVTVRAKFQPKAKKAYSRCLEAIEDGGKSSANKKWREVFGTYVPLATSTSEAAMSYRDTEQFIEDRFPVDVTETVVIDCEVTQAGWRPTWLRAMRSGGILLKADKSLRFVVGSCSVEEPYTLKWKVLNRGPDAERRDMIRGQIVESTRPNTRVESSDFKGEHIVECYVVKDSVVVARDRIEVPISNTSIKASAGS

SEQ ID NO: 5536 - protein, 435 aa, Nocardiopsis kunsanensis
MKTSEIFDALLENLKVGKTATMIAARRDEITKALNKDFRSKEGRTDYKLMVGSFGRHTAIKGVSDLDMIFILPPGIRSDYSSDTGPRRMLERVRDDLKTRYKDTEIRVDQCVVRVQFTSNAFKFEVQPAFKNSDGSFDYPDTVAEGWKVTKPREEIAATKECNDRTSTNMRHLARMARAWKNANGVNMGGLLIDTLVHNFFAQTDDYDSAGTGSFDLMARDFFAFLKDEPEKDYYLALGSRQRVNVKAKFQPKAKKAYGHCLDAIEKAGKAAANKKWREIFGTSVPLAVSEGAKSYRDTEEFIEDRYSVDISGTVLIDCEVTQNGWRPTRLREMLRTGVPLKSNKGLKFLVTSCTVPQPYELKWKVLNRGPEAERRNTVRGQIVGSSKPGVRLEHSDFKGEHVVECYVVKGGVVVARDRIGVPISNTSVKPNSDS

SEQ ID NO: 5537 - protein, 437 aa, Leucobacter sp.
MKTSEIFDTLLENLKVGETSSIVASRRDEIVKALNKDFRDKDGCTDYKLMVGSFGRHTAIKGVSDLDMIFILPPGIRSAYDGDTGPRRILERVRDDLKARYTKTDVRVDQCVVRVQFTSNAFKFEIQPAFENSDGSFDYPDTKAERWKVTKPREEITATKECNDRTSANMRHLARMVRAWKNQNGVNMGGLLIDTLVHSFFSQTDDYDSAGTGSFDRMVRDFFEFLKKEPDKDYYLALGSNQRVAVKARFQPKAKKAYNRCLEAIEDAGKASANKKWREVFGTSVLLSTSTSEASRSFTNTEQFIESWYPVDISEDVTIDCEVTQDGWRPTRLREMLRTGSLLKADRSLTFRLVGCTVAEPYELKWKVVNRGTEAERRDKIRGQIVDSSRPGVRIEHSDFKGEHVVECYVVKAGVVVARDRIDVPISNTSAKAPSIT

SEQ ID NO: 5538 - protein, 435 aa, Piscicoccus intestinalis
MKTSEIFDALLANLKVGDTAASVSSRRDQITKALNKDFRSKDGCTDYKLMVGSYGRHTAIKGVSDLDMIFILPPGIRSNYDSDTGPHRMLERVRDDLKARYPNTTIRVDQCVVRVQFTSNAFKFEVQPAFENDDGSFDYPDTKAEDWKVTKPRDEIAATKECNDRTSTNMRHLARMARAWKNSNGVAMGGLLIDTLVHRFFAQTDDYDSAGTGAFDLMVRAFFEFLKDEPDKDYYLALGSNQRVAVKARFQSKAKKAYNKCLEAIEEMGKSSANKKWREVFGTAVPLATSEASQSFENTEQFIESKYPVDVTEAVTIDCEVTQDGWRPAKLRDMLRTGALLRADRTLKFRVTNCTVEEPYELKWKVLNRGLEAERRNMIRGQVIDSTSTNTRMEHSSFKGEHVVECYIVKDGVVVARDRIDVPISNTSVKSAGAS

SEQ ID NO: 5539 - protein, 375 aa, Micrococcus lylae
MSVRTSEIFGMLLQNLKVGDTASAVASRRDEITKALNKDFRSKDGCTDYQLMVGSFGRHTAIKGVSDLDMIFILPPDIRSNYDGETGPRRMLERVRDVLTDRYKTTSVRVDQCVVRVQFVSNAFKFEVQPAFANADGSFDYPDTKAKAWKVTKPREEIAATKECNDRTSTNMRHLARLARAWKNHNGVSMGGLLIDTLVHRFFSQTSNYDSAGTGSFALMARDFFAFLKDEPDKEYYLALGSNQRVKVNARFQPKAAKAYNRCLEAIADEGKVSANKKWREVFGTSVSLGTSESARSFDNTEQFIEDQHPVDITHSVAIDCQVTQNGFRRFSLREMLHSHAPLMANKDLRFEVTHCTVPLPYEVKWKVLNRGPEA

SEQ ID NO: 5540 - protein, 432 aa, Klebsiella pneumoniae
MSVKTSEIFGTLLQNLKVGKTANTVASRRDEITKALNKDFRSKEGCTDYQLMVGSFGRHTAIKGVSDLDMIFVLPPGIRSDYDGETGPRRMLERVRDDLTARYSNTCIRVDQCVVRVQFASEAFKFEVQPAFKNADGSFDYPDTKAKAWKVTKPREEIAATRKCNDQTSTNMRHLARLARAWKNHNGVSMGGLLIDTLVHRFFSQTSNYDSAGTGSFDLMVRDFFAFLKDEPDKEYYLALGSNQRVKVNARFQPKAAKAYNRCLEAIADEGKVAANKKWREVFGTSVPLETSESARSFDDTEQFIEDQHPVDITHSVAIDCQVTQNGFRRFSLREMLHSRAPLMANKDLRFEVTYCTVPLPYEVKWKVLNRGSEAERRNNIRGQIIDSSEPNVRKERTRFRGAHAVECFVLKDGVVVARDRIDVPISNTSSH

SEQ ID NO: 5541 - protein, 437 aa, Dermacoccus sp.
MKTSEIFDALLANLKVGETAALVATRRDEIVKRLNKDFRSKDSCTDYKLMIGSFGRHTAIKGVSDLDMIFILPAGIRSGYADETGPRRMLDRVRDDLKVTYPNTEIRVDQCVVRVQFATNAFKFEVQPAFENADGSFAYPDTKAKDWKVTKPREEIHAIRECNDRTSTNTRHLARMVRSWKNENGVNMNGLLIDTLVHNFFDQTSDYDAASTGSFDRMARDFFEFLQDEPEQDYYLALGSRQRVHVKAKFQSKAKKAYNRCLEAIDLEGKPSANRKWREVFGTSVPLATTTKESSKSFTDTEEFIEDRFPVDVTASVSIDCEVIQNGFRPMSLRTMRRNGFPLKADRSLRFAVLSCSVPPPYELKWKVLNTGPQAEARNMIRGQIVDSSKPGVRIEHSDFKGEHVVECYIVKDGVVVARDRIEVPISNTAAKPESQY

SEQ ID NO: 5542 - protein, 439 aa, Dermacoccus sp.
MTMKTSEIFDALLANLKVGETAALVATRRDEIVKRLNKDFRSKDSCTDYKLMIGSFGRHTAIKGVSDLDMIFILPAGIRSGYADETGPRRMLDRVRDDLKVTYPNTEIRVDQCVVRVQFATNAFKFEVQPAFENADGSFAYPDTKAKDWKVTKPREEIHAIRECNDRTSTNTRHLARMVRSWKNENGVNMNGLLIDTLVHNFFDQTSDYDAASTGSFDRMARDFFEFLQDEPEQDYYLALGSRQRVHVKAKFQSKAKKAYNRCLEAIDLEGKPSANRKWREVFGTSVPLATTTKESSKSFTDTEEFIEDRFPVDVTASVSIDCEVIQNGFRPMSLRTMRRNGFPLKADRSLRFAVLSCSVPPPYELKWKVLNTGPQAEARNMIRGQIVDSSKPGVRIEHSDFKGEHVVECYIVKDGVVVARDRIEVPISNTAAKPESQY

SEQ ID NO: 5543 - protein, 434 aa, Gordonia aichiensis
MKTSEIFDTLLANLKVGDTAIAIAARRDEITKALNKDFRSKDACTDYKLMVGSFGRHTAIKGISDLDMVYILPPALRPDYNSETGPRRMLERVRDDLKARYPNTEVRVDQCVVRVKFTSNAFKFEVQPAFANDDGSFDYPDTKSETWKVTKPRQEIAATKDCNNRTSTNMRHLARMARAWKNANGVNMGGLLIDTLVYNFFAQTEEYDSAGTGTFDTMARDFFAFLKDEPEQAYYLALGSRQRVNVKAKFQPKAKKAYNRCLEAIGQEGKAAANEKWREVFGTAVPLTTTAAKEAKAHRDTEEFIENLFPVDISESVTIDCEVTQDGWRPTRLRQMLRAGALLRADKSLRFWVTDCSVREPFDVRWKVLNRGPEAERRDMIRGQIVKSTRKNKRVEHSDFKGEHVVECYVIKDGIVVARDRIDVPISNTKIAAA

SEQ ID NO: 5544 - protein, 438 aa, Actinopolyspora halophila
MIMRTSEIFDALLANLKIGDTAATVASRRDEITKALNKDFRSKDGCTDYRMMVGSYGRHTAIKGVSDLDMIFIVPPGLRASYKGERGPRRILERVRDVLKDRYPHTEVRVDQCVVRVQFTSNAFKFEIQPAFENDDGSFDYPDTAAEGWKVTKPRDEIRATKECNDRTSTSMRHLARMARAWKNANGIAMGGLLIDTLVHHFFSTTANYDSAGTGSYASMACDFFEFLKDVLDQDFYLALGSNQRVNVKAKFQPKARKAYDRCREAIADDGKAPANRKWREVFGTSVPLQKVSESSRSFDDTEEFIEDKFPVDITHSVTIDCEVTQNGWRPAFLREMLRGGSPLMADKGLKFTVISCSVEGSYELRWKVRNRGAEAERRNNIRGQIVGSSQPGVRDERTTFQGEHVVECFVLQDGVVVARDRIDVPIKNTSGASGGVS

SEQ ID NO: 5545 - protein, 432 aa, Actinomyces oris
MTTSKIFDKLLTNLKIGGTAEIITSRRDEITKALNKDFRLKDGCMDYRLMVGSFGRHTAIKGVSDLDMIYILPPDTRASYNDENGPRRILERVRDVLKGRYPNTEVAVDQCVVRVQFVKNAFKFEVQPAFEDEDGNFEYPDTVAKCWKITKPRDEISATKECNDRTSKNMRHLARMARAWKNANGVNMGGLLIDTLVYRFFEQNHDYNSSETSSFHLMVRDFFDFLKNEPNQEYYLALGSNQRVKVKSRFQSKAKKAYNRCNEAIGSENNYLAARKWREIFGTSIPLVAEAKDSSFNDTEEFIENLYPIDITTTVHIDCKVTQDGWRPTTLREMLRTHAPLKAEKELKFWITSCSAAEPYEVKWKVLNRGIEAQRRKATRGQVINSSSHNVRIEHSDFRGNHVVECYIIKDGIVVARDCIDVPITTNRAQKR

SEQ ID NO: 5546 - protein, 429 aa, Pseudopropionibacterium propionicum
MTTSEIFDKLLANLKVGDTAKIITSRRDEITKALNKNFRLKDGCTDYRLMVGSFGRHTAIKGVSDLDMIYILPPDIRASYNDENGPRRILERVRDVLKGRYPNTEVAVDQCIVRVQFVKNAFKFEVQPAFEDEDGNFEYPDTFAKCWKITKPRDEISATKECNDRTSKNMRHLARMARAWKNANGVNMGGLLIDTLVYRFFEQNYDYDSAGTSSFHLMVRDFFDFLKNEPNREYYLALGSNQRVKVKSRFQSKAKKAYNRCIEAIASEDDYLAARKWREVFGTSMPLAAKAKDSSFNDTEEFIEDLYSVDITDTLNIDCEVTQDGWRPTKLREMLRTKAPLKAGKKLKFWVTGCSVVEPYTLKWKVLNRGPEAQRRNMIRGGIIDSTKPEARIEHSNFRGDHIVECYVIKDEVVVARDRIDVPITTNGS

SEQ ID NO: 5547 - protein, 431 aa, Actinomyces naeslundii
METAELFAKAISNLKVGDTVLTINARRDEITKSLNKSFRSKEGCTDYKLMVGSFGRHTAVKGVSDLDMIFILPPDIRTSYSDENGPRRILERVRDVLKDRYPKTEVAVDRCVVRVQFVNNAFKFEVQPAFENQDKSFSYPDTVARGWKVTKPRNEILATKVCNDLTSSNMRYLARIVRSWKNAHGVNMGGLLIDTLVYRFFESNRDYDHAGFDSFHLMLRDFFKFLKDEPEQAYYHALGSNQQVKVPCKFQPKAKKAYLHCVAAIEGNAVSAVEKWREVFGSAVPRVAKTNEHSIDDTEEFIENLYPIDITTTVHIDCKVTQDGWRPTTLREMLRTHAPLKAEKELRFWITSCSAAEPYEVKWKVLNRGIEAQHRKATRGQIIESSSHNERIEHSDFRGNHVVECYIIKDGVVVARDCIDVPITTNRAQKR

SEQ ID NO: 5548 - protein, 433 aa, Actinomyces hordeovulneris
METSEIFDALLESLKLGKKASKITSRRDEIVKVLNKDFRSKDDCTDFKLMVGSFGRRTAIKGVSDLDMIYVLPAGIRDDYAGESGPRRMLNRVRDDLKARYPNTDICVDQCVVRVQFVSDAFKFEVQPAFENSDGSFSYPDTKFGGWKLTKPREEIEATKELNDRTSKNMRCLARMVRAWKNASGVSMGGLLIDTLVSNFFERDSEYDRIGTESYGRMMCDFFEFLKDEPEKDYYLALGSRQRVYVKKKFQSKAAKAYIRCVEAIALEGKPDANKKWREVFGPSVPLATSPRESFGSFRDTEEFIEDYFAVEITESVSIDCKVTQDGFRPTWLRMMLKEGVPLLADKSLRFLITDCSVEKPYKLKWKVLNVGPEAEKRDMVRGQIISSISQREHIERSHFKGEHFVECFVVKDGVVVARDRIEVPISNTLLER

SEQ ID NO: 5549 - protein, 433 aa, Rhodococcus sp.
MKTSEVFDGLLANLKVGDTATTVSSRRDEITKSLNKDFRSKDGDTAHKLMVGSYGRHTAIKGVSDLDMIYILPPSIRDDYASESGPRRVLERVRNDLKARYSNTDIRVDQCVVRVQFQSNAFKFEVQPAFANADGSFDYPDTATGSWKVTKPRAEIEATRACNGRTSTNMRHLARMARAWKNANGVGMGGLLIDTLVHRFFAQTNEYDSTGTGSFDLMVRDFFRFLMEEPDKDFYLALGSNQRVKVKARFQPKAKKAYNRCLQAITDEGKASANRKWREIFGRSLPLEAVVESARSFDNTEEFVEQKYPIDIRYTLTIDCTVTQNGWRPTSLREMLRASTLLLPNKGLDFTITACDVPDVYDVRWKVLNQGDEAERRNMIRGQIVEPNRANGRHESTSFRGKHLVECYAIQDGIVVARDRIDVPISATARNAT

SEQ ID NO: 5550 - protein, 430 aa, Unknown
  Description of Unknown: Brevibacterium sequence
MKVSEIFGQLLENLKVGDASTTIAMRRDAIIKALNEDFRSIEGSTAHRLMVGSYGRHTAIRSVSDLDLIFILPSGLRSSYDDENGPRRVLNRVRDVLTKRYPNTDVRVDQCVARVQFTTNKFKFEVQPAFENADGSFDYPDTKSEGWKLTKPHDEIAATKECNDRTSNNMRHLARMARAWKDANGVAMGGLLIDTLVHRFFSTTSEYDDKGPLWFDFMVRDFFEFLANEPNQERYLALGSKQWVAVKARFQPKAKKAYSRCLEAIELEGKAAANRKWREVFGTAVPLADTKTDRTFDDTEEFVEHLYPVDIAYSVAIDCKVTQNGFRTMLLRTMLRDKTPLLARKGLDFIIVECTVPEPYEVKWKVLNQGYEAERRNKIRGQIVPSSRPGTRHEQTNFRGDHVVECYILKDGIVVARDAIDVPISTNNDS

SEQ ID NO: 5551 - protein, 430 aa, Alloactinosynnema iranicum
MKVNEIFDALLENLKVGDASTTIAARRDEITKALNKDFRSVEGSTANRLMVGSYGRHTAIRGVSDLDMIYILPAGLRSSYSSETGPQKMLNRVRNDLTARYPNTDIRVDQCVVRVQFTSNKFKFEVQPAFENSDGSFDYPDTKAEGWKVTKPREEIAATKDRNDRTSTKMRHLARMTRAWKDANGVVMGGLLIDTLVYRFFSKTSEYDDKGSLWFDLMVRDFFEFLMNEPDKDHYRALGSNQRVNVKKRFQPKAKKAHKRCLEAIDNEGKASANKKWREVFGSAVPLEASKAARSFKDTEEFIESRYPVDISESLTIDCKVTQNGWRPASLREMLKNQTLLLPNKKLTFTITGCSVSHPYDVKWKVLNRGDEAERRNNIRGEIISPNHAGNARHEQTSFRGEHVVECYIIKDGIVVARDVIDVPISTNAH

SEQ ID NO: 5552 - protein, 437 aa, Microbacterium sp.
MKTSELFDELLQNLKVGGKNVTVAARRDEIAKALNKEFRGKDGATNNRLMVGSYGRHTAVHAVSDLDMIFIVPNSLRETYADENGPRRMLNRVRDALIARYPTTEVRVDQCVVRVQFTSNAFKFEVQPAFENDDFTFDYPDTVAKAWKCTKPRDEITATKECNDRTHKNMRHLARMVRAWKNHNGAPMGGLLIDTLVHRFFSTTTVYDAATTDTFDEMARDFFEFLKDEPEKDFYLALGSHQRVKVKGKFQSKAKKAHSRCVEAIDAGETTAAAKKWREVFGKAAPLTVTKSLAGAGSAALTFSTEEFIEDVYPVDISATVFIDCEVTQNGWRPRRLLDLLASRQPLLASKDLRFFLTSCDVPEPYELKWKVLNRGPEAVRRDCVRGQIIDSSRPGERREHTSFRGDHVVECFVLKDGIVVARDRIDVPIATTEPGN

SEQ ID NO: 5553 - protein, 430 aa, Mycobacterium abscessus
MKTSEIFDGLLTNLQVDNAGTIGARRDEITKVLNKEFRDLDSSKDHQLMVGSYGRFTAIRGISDLDMLYVLPATLWDKYKGEDGPSNVLSRTRAAIQARYPTSSVKVDSPVVVVAFQNFMFEVQPVFEQGDGSFKYPYTKSKSWKVTKPREEIDETRDYDSITNRNFRKLCKMARAWKNRHGVAMGGLLMDTLAYNFLQKNTDHHSATTATYAFMVRDFFKFLSEEDDHDHYQALGSKQDVKVKKRFQGKAKTAYELCLKAIDAEGKTTVNAKWKKVFGKPVPAADTAPKIASSYTFDNTEEFIEDEFPVDVRYNLTIDCTVSQNGFRPDTLRSMLARHVWLRPQKTLDFTVTECDVPQPYKLKWKVLNRGDEAEKRNEIRGQIINEDSRTHRESTKFRGEHYVECYAIKNGVVVARDHIEVPITTTLQS

SEQ ID NO: 5554 - protein, 428 aa, Mycobacterium fortuitum
MKTSEIFDGLLANLQVDNAGTIGARRDEITKVLNKEFRDLDSSKGHQLMVGSYGRFTAIRGISDLDMLYVLPATLWDKYKGEDGPSNVLSRTRAAIQARYPTSSVKVDSPVVVVAFQNFMFEVQPVFEQEDGSFKYPYTKSKSWKVTKPREEIDETRDCDSITNRNFRKLCKMARAWKNRHGVAMGGLLMDTLVYNFLQKNTDHHSATTATYDFMVRDFFKFLSEEDNHDHYQALGSKQDVKVKKRFQGKAKTAYELCLKAIDAEGKTTVNAKWKKVFGKPVPAADTAPKTASAYTFDNTEEFIEDEFPVDVRYNLTIDCTVSQNGFRPDTLRSMLARHVWLRPRKILDFTVTECDVPQPYKLRWKVLNRGGEAEKRNEIRGQIINEDSRTHRESTKFRGEHYVECYAIKNGVIVARDHIEVPIITAP

SEQ ID NO: 5555 - protein, 428 aa, Mycobacterium abscessus
MKTSEIFDGLLTNLQVDNAGTIGARRDEITKVLNKEFRDLDSSKDHQLMVGSYGRFTAIRGISDLDMLYVLPTTLWDQYKGEDGPSNILSRTRTAIQARYPTSSVKVDSPVVVVTFQNFMFEVQPVFEQEDGSFKYPHTKSKSWKVTKPREEIAETRDYDSITNRNFRKLCKMARAWKNKHGVAMGGLLMDTLAYNFLQKNTDHHSATTATYAFMVRDFFKFLSEEDDHDHYQALGSKQDVKVKKRFQGKAKTAYELCLKAIDAEGQATVNAKWKKVFGKPVPVADTAQKTAGAYAFDNTEEFIEDEFPVDVRYNLTIDCTVTQNGFRPDTLRSMLARHVWLRPQKTLDFTVTECDVPQPYKLKWKVLNRGDEAEKRNEIRGQIINQDSRTHRESTRFRGEHYVECYAIKNGVIVARDHIEVPITTAS

SEQ ID NO: 5556 - protein, 428 aa, Mycobacterium fortuitum
MKTSEIFEGLLTNLQVDNAGTIGARRDEITKVLNKEFRNLDSSKDHQLMVGSYGRFTAIRGISDLDMLYVLPASLWDKYKGEDGPSNVLSRTRAAIQARYPTSSVKVDSPVVVVTFQNFMFEVQPVFEQEDGSFKYPHTKSKSWKVTKPREEIAETRDYDSITNRNFRKLCKMARAWKNKHGVAMGGLLMDTLAYNFLQKNTDHHSATTATYDFMVRDFFKFLSEEEDHDHYQALGSKQDVKVKKKFQSKAKTAHELCLKAIDAEDKATVNAKWKKVFGKPVPAADTIPKTASAYTFDNTEEFIEDEFPVDVRYNLTIDCTVTQNGFRPDTLRSMLARHVWLRPQKTLDFTVTECDVPQPYKFKWKVLNRGDEAEKRNEIRGQIINEDSRTHRESTKFRGEHYVECYVIKNGVIVARDLIEVPITTTP

SEQ ID NO: 5557 - protein, 430 aa, Mycobacterium kansasii
MKTSEIFEGLLTNLQVDNAGTIGTRRDEITKVLNKEFRNLDSSKDHQLMVGSYGRFTAIRGISDLDMLYVLPSSLRDKYEGEDGPSDVLSRTRAAIQARYPTSSVKVDSPVVVVTFQNFMFEVQPVFEQADGSFMYPHTKSKSWKVTKPREEINETRDYDSITNRNFRKLCKMARAWKNKHGVVMGGLLMDTLAYNFLQKNTDYHFATMTTYAFMVRDFFRFLSEEDDHDHYQALGSKQDVKVKKRFQSKAKTAYELCLKAIDAEGNTTVNAKWKKVFGKPVPAADGTAKTASAYTFDHTEEFIEDQFPVDVRYTLTIDCTVTQNGFRPDTLRSMLTRHVWLRPQKTLNFTVTECDVPRPFKFKWKVLNRGEEAEKRNEIRGQIINDDTRTHRESTNFRGEHYVECYAIKNGVVVARDHIDVPITTAQHA

SEQ ID NO: 5558 - protein, 430 aa, Mycobacterium asiaticum
MKTSEIFEGLLTNLQVDNAGTIGARRDEITKVLNKEFRNLDSSKDYQLMVGSYGRFTAIRGISDLDMLYVLPSSLWDKYEGGDGPSDVLSRTRAAIQARYPTSSVKVDSPVVVVTFQNFMFEVQPVFEQADGSFKYPHTKSKSWKVTKPREEINETRDYDSITNRNFRKLCKMARAWKNKHGVVMGGLLMDTLAYNFLQKDTDYHSATMTTYAFMVRDFFRFLSEEDDHDHYQALGSKQDVKVKKRFQSKAKTAYELCLKAIDADGNTTLNAKWKKVFGKPVPAADSTAKTASAYTFDHTEEFIEDEFPVDVRYTLTIDCTVTQNGFRPDTLRSMLARHVWLRPQKTLNFTVAECDVPQPFKFKWKVLNRGEEAEKRNEIRGQIINDDTRTHRESTKFRGEHYVECYAIKNGVVVARDHIDVPITTAQHA

SEQ ID NO: 5559 - protein, 428 aa, Mycobacterium chelonae
MKTSEIFDGLLTNLQVDNAGTIGARRDEITKVLNKEFRNLDNSKDNQLMVGSYGRFTAIRGISDLDMLYVLPSSLWDKYEGENGPSDVLSRTCAAIQARYPTSSVKVDSLVVVVTFQNFMFEVQPVFEQEDGSFKYPYTKSKSWKVTKPRDEISETRDCDSITNRNFRKLCKLARAWKNKHGVVMGGLLMDTLAYNFLQKNTDHHSATTVTYAFMVRDFFKFLSEEDNHDHYQALGSKQDVKVKKRFQRKAKTAYELCLKAIDAEGKNTVNAKWKKVFGKPVPAADTTAKTASAYPFDNTEEFIEDKFPVDVRYNLTIDCTVTQNGFRPDSLRSMLARQVWLRPQKTLDFTVTECDVPQPYKLKWKVLNRGDEAEKRDEIRGQIINEDSQTHREATKFRGEHYVECYAIKNGVVVARDHLEVPITTAP

SEQ ID NO: 5560 - protein, 428 aa, Mycobacterium sp.
MKTSEIFEGLLTNLQVDNAGTISARRDEITKVLNKEFRNLDSSKDHQLMVGSYGRFTAIRGISDLDMLYVLPSSLWDKYNGEDGPSDVLSRTRAAIQARYPTSSVKVDSPVVVVAFQNFMFEVQPVFEQEDGSFKYPHTKSKSWKITKPREEIIETRDFDSITNRNFRRLCKMARAWKNKHGVVMGGLLIDTLVYNFLQKNTDHHSAAAAAYAFMVRDFFKFLSEEDDHDHYQALGSKQDVKVKKRFQGKAKTAYELCLEAIEADGKTTANAKWKKVFGKPVPAAETTAKTASAYTFDNTEEFIEDEFPVDIRYNLSIDCTVTQDGFRPNTLRSMLARQVWLRPQRTLDFTVTECDVPQPYKFKWKVLNRGDEAERRNEIRGQIINEDSRTHRESTKFRGEHYVECYAIKNGVIVARDHIEVPITTAP

SEQ ID NO: 5561 - protein, 427 aa, Mycobacterium sp.
MKTSEIFDGLLTNLKLDNDDALTSRRDEIAKVLNKEFRGLVDATNNRLMVGSYGRFTAIRGISDLDLLYFLPSSLWDTYKGEGGPSDVLSRTRNAIQARYTTTSVKVDRLVVVVQFQNFKFEVQPVFEQEDGSFQYPDTYSKSWKVTKPRAEIEAIGTYDSMTTGNLRKLCKMTRAWKNKHGVAMGGLLIDTLAYNFFQKTTDFDTVTTAGYDLMVRDFFKFLADEDVHDHYQALGSNQDVKVKKKFQGKAKTAYELCLEAIEAEGKSSANKKWKKVFGRPVPVADTTKEAASAYSFRNTEEFIEDKYPVDVRYPLSIDCTVTQDGFRPNTLRDMLTRNIWLRPQKTLDFNITECGVREPYMIKWKVLNRGDEAERRDAIRGSILDQDSKTHRESTSFRGEHYVECYIIKDGVVVARDHIDVPITTS

SEQ ID NO: 5562 - protein, 429 aa, Lentzea guizhouensis
MKSSEIFEGLLKNLKIDNRSAIINRRTEIVKALNKEFRGVDKSTRNQLMVGSYGRGSAIRGISDLDMLFILPASIRDAHKKADGPEKILTRTRTAIKARYPDTEVKVDRLVVVVQFQNFKFEVQPVFENEDESFSYPDTYSKSWKVTKPRAEIEAIRAKDALSKGNLRNLCKMVRAWKNAHGVVMSGLLIDTLTHNFIRDNEEYHTATPVSYGLMARDFFKFLSEEEDHEHYAALGSGQQVKVKKKFQRRAKRAYELCDAAIAAEGKTVANKKWKAVFGKPVPSAAAAAAARESVGFRDTEEFIEDRYPVDIRHTVLIDCTVSQDGFRPQKLRTMLQHRWPLRPRKKLLFAIVECEVPEPYKVKWKVLNRGPEAERLDRVRGQIIDPNQSRARGEETNFRGDHYVECYVIKNGVVVARSRIQVPIEPEQ

SEQ ID NO: 5563 - protein, 432 aa, Unknown
  Description of Unknown: Microbacterium sequence
MSQTGDIFDGLLTNLRVNTAESIADRRDEVTKALNSEFRSLTGSTANKLMVGSYGRWTAIKGISDLDLLYILPSSLRASYEEEGGPLKALRRARAAIQKRYPTTTVGVDRLVVVVEFSNFTFEVQPVFENEDGSFDYPDTYSDSWKMTKPRDEISAISEEDSATSGNLRRLCKLARAWRNKQGVVMGGLLVDTLAYNFLTSTTEHRSGTSESYGEMMRDFLLYLADQVDHDFYLALGSRQRVRVKKRFQKKAASGAELCTEAVDAAGQKNEYKKWRAVFGKSVPAVVAGGENALAARSFNDTEEFIEDTHPVDIRFSVEISCTVTQDGFRPTSLNSFLNLFSLLPAKKQLTFAIDNIDVPGSYEVRWKVLNRGAEAERRDHVRGEIIRPTHGTERREVTSFRGNHYVECYVIQRNVVVARGHIDIPIAAESS

SEQ ID NO: 5564 - protein, 437 aa, Clavibacter tessellarius
MTQTADIFDALLSNLAVDTTENIATRRDEITKALNSEFRDLEGSDANKLMVGSYGRATAIKGISDLDLLYILPSSLNVDYHSAGGPRKALQRSRDAIAKRYSNTTVRVDRLVVVVEFTNFMFEVQPVFENDDTSYDYPDTYSDSWKVTKPRDEIAATKETNNTTSGNLRRLCKLTRAWRNKHGIVMGGLLVDTLAYNYLTSHDAHHSSNSELYGEMIRDFLRYLADQEDHDFYVALGSRQRVKVKKRFQKSAASGADLCDEAISAAGTKSEFKKWRAVFGKASPAEPATAKTLSAAALPVGRFTDTEQFIEDQYAVDIRHGLDITCIVTQAGFRPISLTQYLIKHRRLPPKKTLSFTIDNTDVPLPYEVRWKVLNRGPEAERRDQIRGDIIRGNYAGGNERREPTAFRGDHYVECYVIRHGIVVARAHLYVPIEAGS

SEQ ID NO: 5565 - protein, 428 aa, Curtobacterium sp.
MTTTSDMFDGLMTNLTVDTSDKIAQRRDEITKSLNFEFRSIEGSTANKLMVGSYGRWTATRGISDLDLLFILPASVRNDYTKAGGPSRLLARVRKAIEKRYANTSVTVDRLVVVVHFRDFKFEVQPVFENTDSYSYPDTKSDSWKLTKPRAEIDEMRAENIRTNGSLRRLCKLVRAWKNKHGVPISGLLIDTLVYNFIGDRTEFHSSSAVFDDEMVKEFFLFLAEEEDHDFYAAVGSKQRVAVKGRFQPKARKAYNLALKAIEADGQKNAYKKWRDIFGRVVPAPASDALAASATRFADTEEFVEDSYRVDIRYSVGIDCEVTQDGFRPSMLREMLQRRTWLLPRKQLKFRIVHTDVPGPFVVRWKVLNRGPEAERRDAIRGGLIEPNYGRERHETTSFSGTHHVECYLIQDGTVVARDDIEVPITTS

SEQ ID NO: 5566 - protein, 425 aa, Actinomyces naeslundii
METSDTFTTFLNNLKIGNRDEIVKRRDEITRLLNREFRSLNDSTHYQLMIGSFGRHTAINGVSDLDMLYIMPPSLWSSYNKDSGPVSALSRVRQSLKAHYPQTEIKVNQCIVSIQFTNFRFEVQPVFENSDESFKFPDTYSNTWKIAKPREEIKEISSTDSITGGNLRDLCKMVRAWRNKHGVVMGGLLIDTLAYNYLQSTSDHRSSSVSTYGHMVRDFFSYISKEPYKEYYLAVGSRQQVKVKKSFQHEAKQAYKLCDEAIKIDGSTSAVSKWKELFGRPFPAKPLKRDNLSYDNTEQFIEDCYPVDIRNTVTIDCKVTQNGFMPRQLREMLSRQIPLLPKKTLDFTITSCDVTSPHEVRWKVLNRGKEAERRNEIRGQIIRPNRQNGHRETTRFRGDHYVECYVLVNGVVVARDRIDVPISSS

SEQ ID NO: 5567 - protein, 428 aa, Chlamydia trachomatis
MSALDVFDKIFDNLKISNKEEIRNHRDEITKALNREFRDSDSESDNRLMVGSWGRCTAINGVSDLDFLYILPSHLYDEFHVSGGTCKVLSKVKQAIVTHYSRTDIRVNQLVVVVNFENYKFEVQPVFEQEDGSFLYPDTYSDSWKTTKPRDEIKAISDLDTASNGNARKICKLARAWNNKHDVIMGGLLIDTMAWRFLNDNDEYFNATNHPDYMIRDFFKYLSNLPKQESWNALGSNQKVKVKKNFQVKALEAYDLCCAAIDESDEVKSYNKWREVFGKFVPLSEYEQVAKDLFTSYDDTEQFIESFYPIDLQYELNLECKVTQDGFRPANLRDMIMNHIWLKPNKKLEFYITNTDLPTPYSLKWKVCNCGEEAKKRNCIRGQIIDGTSSNTREEYTVFRGEHYVECYAIYYGVVIAKGKIAVPITTN

SEQ ID NO: 5568 - protein, 428 aa, Gardnerella vaginalis
MSALDVFDKIFDNLKISNKEEIRNRRDEITKALNREFRDSDSESDNRLMVGSWGRCTAINGVSDLDFLYILPSHLYDEFHVSGGTCKVLSKVKQAIVTHYSRTDIRVNQLVVVVNFENYKFEVQPVFEQEDGSFLYPDTYSDSWKTTKPRDEIKAISDLDTASNGNARKICKLARAWNNKHDVIMGGLLIDTMAWRFLNDNDEYFNATNHPDYMIRDFFKYLSNLPKQESWNALGSNQKVKVKKNFQVKALEAYDLCCAAIDESDEVKSYNKWREVFGKFVPLSEYEQVAKDLFTSYDDTEQFIESFYPIDLQYELNIECKVTQDGFRPANLRDMIMNHIWLKPNKKLEFYITNTDLPTPYSLKWKVCNCGEEAKKRNCIRGQIIDGTSSNTREEYTVFRGEHYVECYAIYYGVVIAKGKISVPITTN

SEQ ID NO: 5569 - protein, 428 aa, Gardnerella vaginalis
MSALDVFDKIFDNLKISNKEEIRSRRDEITKALNREFRDSDSESDNRLMVGSWGRCTAINGVSDLDFLYILPSHLYDEFHVSGGTCKVLSKVKQAIVTHYSRTDIRVNQLVVVVNFENYKFEVQPVFEQEDGSFLYPDTYSDSWKTTKPRDEIKAISDLDTASNGNARKICKLARAWNNKHDVIMGGLLIDTMAWRFLNDNDEYFNATNHPDYMIRDFFKYLSNLPKQESWNALGSNQKVKVKKNFQVKALEAYDLCCAAIDESDEVKSYNKWREVFGKFVPLSEYEQVAKDLFTSYDDTEQFIESFYPIDLQYELNLECKVTQDGFRPANLRDMIMNHIWLKPNKKLEFYITNTDLPTPYSLKWKVCNCGEEAKKRNCIRGQIIDGTSSNTREEYTVFRGEHYVECYAIYYSVVIAKGKISVPITTN

SEQ ID NO: 5570 - protein, 428 aa, Gardnerella vaginalis
MSALDVFDKIFDNLKISNKEEIRNRRDEIAKVLNKEFRDSDSESDNRLMVGSWGRCTAIDGVSDLDFLYILPSHLYDEFHVSGGTCKVLSKVKQAIVAHYSRTDIRVNQLVVVVNFKNYKFEVQPVFEQEDGSFLYPDTYSDSWKTTKPRDEIKTISDLDTASNGNARKICKLSRAWNNKHNVTMGGLLIDTMAWRFLNDNDEYFNATNHPDYMIRDFFKYLSNLPKQEFWNAPGSNQRVKVKKNFQVKAAEAYKLCCVAIDESDEDKSYKKWREVFGRFVPLSDHEQVAKDLFTSYDDTEQFIENFYPIDLKDELNLECKVTQDGFRPASLRDMIRNHIWLKPNKKLEFYITNTNLPTPYSLKWKVCNCGEEAKKRNCIRGQIIGGTTSKTREEYTVFRGEHYVECYAIYYGVVIAKGKISVPITTN

SEQ ID NO: 5571 - protein, 428 aa, Gardnerella vaginalis
MSALDIFDKIFDNIQISNKEEIRKLRDEITKALNKEFRNSYSKSDNWLMVGSWGRHTAIDGVSDLDLLYILPSSLWDDYHTIDGTKKVLSKVKQAIVTHYSRTDIRVDRLVVVVNFKNYKFEVQPVFEQDDGSFLYPDTYSDSWKTTKPRDEIKAISNLDETSMGNARKICKLARAWKNKHSVLIGGLLIDTMAWRFLNDNDEYFNTANHPDYMIRDFFEYISNLPKQESWNALGSNQRVKVKKNFQEKAAEAYNLCRAAIDEVDEDKSYMKWREVFGRFVPLSDYEQVAKDLFTSYDDTEQFIENFYPIDLQYELNLECKVTQDGFRPASLRDMIRNHIWLKPNKKLEFYITNTDLSTPYSLKWKVCNCGEEAKKRNCIRGQIIDGTTSNTREEHTVFRGEHYVECYAIHYGVVITRGKISVPITTD

SEQ ID NO: 5572 - protein, 428 aa, Gardnerella vaginalis
MSALDVFDKIFDNLQISNKEKIINRRDEITKALNKEFRDSESESDNRLMVGSWGRHTAIDGVSDLDLLYILPSSLWDDYHTVDGTKKVLSKVKQAIATRYSQTDLRVDRLVVVVNFKNYKFEVQPVFEQDDGSFLYPDTYSDSWKTTKPRDEIKAISNLDETSMGNARKICKLARAWKNKHDVLMGGLLIDTLAWRFLSDNNEYFNDTNHPYYMIRDFFKYLTNLPKQESWDALGSNQKVKVKKDFQEKAAEAYKLCCVAIDENNEDTSYKKWREVFGRFVPLSDYEQAAKDLFTSYDDTEQFIENFYPIDLQCELNLECKVTQDGFRPANLRDMIMNRIWLKPNKKLEFYITNTDLPTPYSLKWKVCNCGEEAKKRNCIRGQIIDGTSSNTREEYTVFRGEHYVECYAIHYGVVIAKGKISVPITTN

SEQ ID NO: 5573 - protein, 270 aa, Bifidobacterium pseudolongum
MTGFVEMFDATLFNLKVGSERAQVIRNRRDEITKALNKGFRDTESAQNNRLMVGSWGRNTAINGVSDLDMIYVLPESLRDETRRESGAEKILSKTRDYLRERYPATNIKVDHLVVVVQFADFKFEVQPCFENEDGSFDFPDTYAKTWKRTDPRSEIKELQAVNDRTHGNARILCRLVRAWKNKHAVKMNGLLVDTFVWRFMNEHDEYSLGRTLLYDQMLLDFFKYLAQLPKKEYWMALGSNQRVNVAKPFQIKAKKNYWVVPRGYRCGRH

SEQ ID NO: 5574 - protein, 427 aa, Corynebacterium pyruviciproducens
MSPIIELFEDTLENLKVANADQIKARRDEITRSLNKHFRSSNSDTLYRLMVGSWGRHTAIDGVSDLDMIYILPPSLRGELHKTGGCRKALQRTKSAIAKHYSTTSITVDHLVVVVQFSDFKFEIQPCFENSDGSFEYPDTYSDSWKRTNPRAEIEAMRNLNDETSGNARILCRLARAWRRKHDVEMNGLLIDTLVWRFFDQTRIYRVPTLLYDQIALEFFTFLSQLPKQEKWNALGSRQVVKVKKNFQGKAKKAAEFCSDAIASEEKASMYTKWRKVFGRFVPANANSRTLEPREQYQDTEEFIEDFYPLDIQHDMQINCTVTQNGFRPMSLKYMLQKRIWLRPSKFLHFEISTTVPEPFELRWKVLNRGEEAERLDCVRGQIIKGAGKRDHQEHTDFRGDHYVECYVIQNGVVVAQSRIDVPIRWE

SEQ ID NO: 5575 - protein, 427 aa, Alloscardovia omnicolens
MSKSTEILKETVNNLKISNADVIRNRRDEITKKLNSKFRDVDSHSQYRLMVGSWGRHTAIDGISDLDMIYILPPELKSVLHSKHGTQKTLSLAKEAIIERYPETTVRIDRLVVVVDFKDFKFEIQPCFEEQDNSFLYPDTYSDTWKKTDPRKEIYEMCDLDTKTDGNARVLCRLMRAWKRKHEIQMNGLLLDTLVWRYFSGIDSYKNSGFALECMIRDFFDYLSQQPNQDYWCALGSNQKVYSKHPFQRQAKEAADLTRKAIAAEDTIGLSDKWKQIFGRFVKPQNTNNNSAKTTYNDTEEFIENRFDIDIKNDLYIECIVTQDGFRPQNLSRMIRDHILLRPNKKLEFSIITNAQKPYTLLWKVLNRGHEAVKRNMVRGQIFEDSNSKDKHTELTEFAGEHYVECYLIKNNVVVARGHQDVPIRIP

SEQ ID NO: 5576 - protein, 429 aa, Corynebacterium jeikeium
MDQNELLSETLNNLKIDNANIIEQRRDEITKALNKEFAGSESDSTNRLMVGSWGRHTAIRGISDLDMLYRLPAFLRDEFVADGGAYKALSQVRTALKHRYPKTEIGVDRYVVKVQFGDFKFEVQPVFETDEGHFEYPDTYKDCWKLTKPRDEIEAIRELDGSTGGKARKLCKLTRAWKKKHDVPINGLLIDTLVHRYLASQLADDVTLPRLPILIKEFFDYLSELPKQDTWYALGSGQKITNERNFQNKAKEALSLCQDAIAANGKSTMNQKWRSIFGKCVPLDSNDQARATRLETFNYIDTEQFIEERFPTAATVSELAVECMVTQNGFRSGPLRRILETYNFLRPHKQLDFTVDTRDLPPRTELWWKVLNRGDEAKRRNQIRGQIFKDSGKGKHRESTLFSGHHYVECYAIRDGVLIARGHVDVPIS

SEQ ID NO: 5577 - protein, 436 aa, Corynebacterium jeikeium
MAEEVTVVDQNELLSETLNNLKIDNANIIEQRRDEITKALNKEFAGSESDSTNRLMVGSWGRHTAIRGISDLDMLYRLPAFLRDEFVADGGAYKALSQVRTALKHRYPKTEIGVDRYVVKVQFGDFKFEVQPVFETDEGHFEYPDTYKDCWKLTKPRDEIEAIRELDGSTGGKARKLCKLTRAWKKKHDVPINGLLIDTLVHRYLASQLADDVTLPRLPILIKEFFDYLSELPKQDTWYALGSGQKITNERNFQNKAKEALSLCQDAIAANGKSTMNQKWRSIFGKCVPLDSNDQARATRLETFNYIDTEQFIEERFPTAATVSELAVECMVTQNGFRSGPLRRILETYNFLRPHKQLDFTVDTRDLPPRTELWWKVLNRGDEAKRRNQIRGQIFKDSGKGKHRESTLFSGHHYVECYAIRDGVLIARGHVDVPIS

SEQ ID NO: 5578 - protein, 436 aa, Corynebacterium lipophiloflavum
MAEEVTVVVQNELLSQTLDNLKIDNADIIEQRRDEITKALNKEFAGSESDSTNRLMVGSWGRHTAIRGISDLDMLYRLPAFLRDEFVANGGAYKALSKVRTALKQRYPKTAIDVDRLVVKVQLADFKFEVQPVFETDEGHFEYPDTYKDCWKLTKPRDEIEAIRELDGSTGGKARKLCKLTRAWKKKHDVPINGLLIDTLVHRYLTSQLADDMALPRFPILVKEFFDYLSELPKQDTWYALGSGQKITNERHFQNKAKEAFSLCQDAIAANGKSTMNQKWRSIFGKCVPLDSNDQARATSLETFNYIDTEQFIEERFPAAAIVSELAVECMVTQNGFRSGPLRRILGTYNFLRPNKQLDFTVDTRDLPPRTELWWKVLNRGDEAKRRNQIRGQIFKDSGKGKHRESTLFSGHHYVECYAIKDGVLIARGHVDVPII

SEQ ID NO: 5579 - protein, 429 aa, Corynebacterium spheniscorum
MSSARILFDQTLSNLKVTNAEVIAKRRQEITKALNRHFRDSESEESNCLMVGSYGRHTAINGVSDLDMLYILPDSIREDYNKEAGPYKALKATKDAIAGHYSRTKTQVDRLVVVVDFNDFKFEVQPVFENADGSFDYPDTVADTWKTTKPRAEIDEMRRANELTDGNARTICRLARAWKRKHEVPMNGLLIDSLAVRFLNESKDYDTRATKPDYMMRDFFAFLAELPRQPTFAALGSNQRIKVKQNFQAKAKRAMELSDKAIDAVDEGATAKKWRRVFGRFVPLPNDGRAASKEEYKDTEEFIEDYYTVGIEYTLQIECKVTQNGFRPYSLRQMLKDKIFLRPNKKLDFWIEHTNTPEPYAVRWKVLNRGHVARQRDTIRGQIIKGRGARTHVEYTEFSGAHYVECYLIKGNTVVAKDHLEVPISTHDR

SEQ ID NO: 5580 - protein, 422 aa, Rothia nasimurium
MPSPAELFDQILKNLKVSNYQEIENRRDEIIKSLNGEYRADPDSTGHRLMVGSYGRHTAINGVSDLDLLYILPPDLRNKYRSPEGPYRALKRTKDAILRRYPTTDVSVSQLVVAVKFQNFTFEVQPVFQEKDGDFAYPDTKKKLWLRTKPRKEIEAIKEFNTESSGSLRVLCRLTRSWKNKHDVHIGGLLIDTLAFNFLKQNEQYQSGKRYDQMLSDFLAWLSNEPRKCYYLAPGSNQQVRVKQAFQRKASAAHELALKAIDSEDSDSYAQRWRDLLGKPVPLSDDQKSRNHDYINSEQFIEDYYPQNIRYTLDIDCKVKDQNQSNWLSGLLRRRLRLSRERKLLFEVTFCDVPAPFELKWKVLNQGEEARERNMIRGQILDDNGSQCLQETSDFYGDHFVECYAIKDGKLVARAHISVPIG

SEQ ID NO: 5581 - protein, 154 aa, Yersinia pseudotuberculosis
MNKTDMFNQLLNNLKIDLKQAKKISYHYRKITKSLNLKFRGTDSCIANRLKVGSIGRHSAIKGISDLDMLYIMPAGLYDTYNRMENGQSALLSDVRNKLAIEYPDQDVRKDRLVVQVVFKHFQVEVQPVFKQQDGSFKYPESYYGGSGENNQAK

SEQ ID NO: 5582 - protein, 429 aa, Corynebacterium ulcerans
MTFEVQLFAEVLELLKVDNLEDIDRRRDEITKALNKDFRDSSSTKHNRYYIGSFGRHTAIRGISDLDLMYILPPSLKDGYLGAGGALRSLNRIRDVLKARYSTTNIRVDRTIVVVEFGDFRFEVQPVFTDEGKYLRPDSYTDQWKTVDPSAERSIFRDINLQSDGTARRLSRLARAWKQYHDAPMNGLLIDTFVQRFLSGQEDEYRTSRNPGQMMLDFFNYLVEQPEQDFYRAMGSKQEITVKKPFQAKAKMAAGLAEEAIGKNSETSLRNAWKKLFGKFVQVSASDQLKATVSERLYGYKNTEEFIEDLYPVDLTYRVVLDCKVTQNGFRPDWLRRILARNDWLAPKKQLDFEIVQNDVPAPYEIRWKVLNTGEEAYKRDHVRGQILKGGNRCQEVTVFRGRHQVECFVIKDGVVVARDKIDVPISSN

SEQ ID NO: 5583 - protein, 460 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLIRRFRLSARKSLLFRADLTEMEAEEPYTVMWKVLNVGDEARRRNMIRGQIVSDGGYCTKKETTDFRGDHMVECYVIKNEVVVARAQIEVPISLGFYDAIRDAEINRPTWL

SEQ ID NO: 5584 - protein, 460 aa, Escherichia coli; identical to SEQ ID NO: 5583

SEQ ID NO: 5585 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKLLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLIRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5586 - protein, 442 aa, Unknown
  Description of Unknown: Enterobacteriaceae sequence
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLIRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5587 - protein, 431 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVV

SEQ ID NO: 5588 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYSGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5589 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYSVMWKVLNVGDEARRRNMIRGQIVSDGGYCTKKETTDFRGDHMVECYVIKNEVVVARAQIEVPIS

SEQ ID NO: 5590 - protein, 442 aa, Citrobacter rodentium
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGGASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5591 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADVVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5592 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFHGDHMVECYVIKNEVVVARAQIEVPIS

SEQ ID NO: 5593 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPII

SEQ ID NO: 5594 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTNFRGDHMVECYVIKNEVVVARAQIEVPIS

SEQ ID NO: 5595 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFDRAAKHAYELCCDALDAEGAASENDRWRKVFGRAFPRRKVGIMEARLGLESHAADAVPWTDTEEFIEDKYPVDIRYSLNLDCTVTQDGFPPRSLSEMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5596 - protein, 442 aa, Escherichia coli; identical to SEQ ID NO: 5595

SEQ ID NO: 5597 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLSEMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5598 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTNTEEFIEDKYPVDIRYSLNLDCTVTQDGFPPRSLREMLTRRFRLSARKSLLFRADLTEMEAEEPYTVMWKVLNVGDEARRRNMIRGQIVSDGGYCTKKETTDFRGDHMVECYVIKNEVVVARAQIEVPIS

SEQ ID NO: 5599 - protein, 442 aa, Escherichia coli
MSHRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQIIFKNFYVEVQPVFRQDDDSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERKERYLALGSNQHVRVKSPWFGRAAKHAYELCCDALDAEGAASENDRWRKVFGRAFPRRKVGIMEARLGLESHAADAVPWTDTEEFIEDKYPVDIRYSLNLDCTVTQDGFPPRSLREMLIRRFRLSARKSLLFRADLTEMEAEEPYTVMWKVLNVGDEARRRNMIRGQIVSDDGYCTKKETTDFRGDHMVECYVIKNEVVVARAQIEVPIS

SEQ ID NO: 5600 - protein, 237 aa, Salmonella enterica
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYL

SEQ ID NO: 5601 - protein, 442 aa, Escherichia coli
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDRGYCTKKEATDFRGDHVVECYVIKNEVVVARAQIEVPIN

SEQ ID NO: 5602 - protein, 442 aa, Unknown
  Description of Unknown: Enterobacteriaceae sequence
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKEATDFRGDHVVECYVIKNEVVVARAQIEVPIN

SEQ ID NO: 5603 - protein, 442 aa, Unknown
  Description of Unknown: Enterobacteriaceae sequence
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5604 - protein, 442 aa, Salmonella enterica; identical to SEQ ID NO: 5603

SEQ ID NO: 5605 - protein, 442 aa, Escherichia coli
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGAASENDLWRKVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5606 - protein, 442 aa, Escherichia coli
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEWSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5607 - protein, 442 aa, Escherichia coli
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHSADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5608 - protein, 442 aa, Salmonella enterica
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAKEPYTVMWKVLNVGDEARRRNMIRGQIVSDGGYCTKKETTDFRGNHVVECYVIKNEVVVARAQIEVPIN

SEQ ID NO: 5609 - protein, 442 aa, Salmonella enterica
MSRRELFSEFLENLNLDLKQAKKISYHYRKITKSLNLAFRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSQGALARDFFEYLSNEEKRERYLALGSNQYVRVKSPWFGRAAKHAYELCCDALDAEGAASENDLWRKVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5610 - protein, 404 aa, Escherichia coli
FRGTSSRVANRLKVGSVGRHTAIKGISDLDMLYIMPPNQYEYYNRKDNGQAALLTDVRNILAEEYPDQTVKKDRLVVQIIFKNFYVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEEKRERYLALGSNQYVRVKSPWFGRAAKHAYELCCDALDAEGSASENDLWREVFGRAFPRRKVGIMEASLGLESHAADAAPWIDTEEFIEDKYPVDIRHSLNLDCTVTQDGFPPRSLREMLTRGFRLSARKSLLFRADLTEMEAEEPYTVMWKVLNVGDEARRRNMIRGQIVSDGGYCTKKETTDFRGDHVVECYVIKNEVVVARAQIEVPIN

SEQ ID NO: 5611 - protein, 442 aa, Citrobacter freundii
MSRRELFSEFLENLNLDLKQAKKISYHYRKITKSLNLAFRGTSSRVANRLKVGSVGRHTAIKGISDLDMLYIMPSNKYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERRERYLALGSNQYVRVKSPWFGRAAKHAYELCCDALDGEGAASENDRWRKVFGRAFPRRKVDIMEARLGLESHAADAAPWADTEEFIEDKYPVDIRYSLNLDCTVTQDGFPPRSLREMLTRRFRLSARKSLLFRADLTEMEAEEPYTVMWKVLNVGDEARRRNMIRGQIVPDGGYCTKKETTDFRGDHVVECYVIKNEVVVARAQIEVPIS

SEQ ID NO: 5612 - protein, 442 aa, Cronobacter sakazakii
MSRRELFSEFLENLNLDLKQAKKISYHYRKITKSLNLAFRGTSSRVANRLKVGSVGRHTAIKGISDLDMLYIMPPNKYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERRERYLALGSNQYVRVKSPWFGRAAKHAYELCCDALDGEGAASENDRWRKVFGRAFPRRKVDIMEARLGLESHAADAAPWADTEEFIEDKYPVDIRYSFNLDCTVTQDGFPPRSLREMLTRRFRLSARKSLLFRADLTEMEAEEPYTVMWKVLNVGDEARRRNMIRGQIVPDGGYCTKKETTDFRGDHVVECYVIKNEVVVARAQIEVPIS

SEQ ID NO: 5613 - protein, 442 aa, Cronobacter sakazakii
MSRRELFSEFLENLNLDLKQAKKISYHYRKITKSLNLAFRGTSARVANRLKVGSVGRHTAIKGISDLDMLYIMPPNKYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGALARDFFEYLSNEERRERYLALGSNQYVRVKSPWFGRAAKHAYELCCDALDGEGAASENDRWRKVFGRAFPRRKVDIMEARLGLESHAADAAPWADTEEFIEDKYPVDIRYSFNLDCTVTQDGFPPRSLREMLTRRFRLSARKSLLFRADLTEMEAEEPYTVMWKVLNVGDEARRRNMIRGQIVPDGGYCTKKETTDFRGDHVVECYVIKNEVVVARAQIEVPIS

SEQ ID NO: 5614 - protein, 442 aa, Cronobacter sakazakii
MSRRELFSEFLENLNLDLKQAKKISYHYRKITKSLNLAFRGTSSRVANRLKVGSVGRHTAIKGISDLDMLYIMPPNKYEYYNRKDNGQSALLTDVRNILAEEYPDQTVKKDRLVVQVVFKNFHVEVQPVFRQDDGSFKFPESYNGGAWRITKPLQEKAAMTAFSRDKSNNLRKLCKMIRAWKNLHGVNMGGLLIDTLAYRFLSSTSDYDNTGNGSLGALARDFFEYLSNEERRERYLALGSNQYVRVKSPWFGRAAKHAYELCCDALDGEGAASENDRWRKVFGRAFPRRKADIMEARLGLESHAADAAPWADTEEFIEDKYPVDIRYSLNLDCTVTQDGFPPRSLREMLTRRFRLSARKSLLFRADLTEMEAEEPYTVMWKVLNVGDEARRRNMIRGQIVPDGGYCTKKETTDFRGDHVVECYVIKNDVVVARAQIEVPIS

SEQ ID NO: 5615 - protein, 442 aa, Unknown
  Description of Unknown: Enterobacteriaceae sequence
MSRRELFSEFLENLNLDLKQAKKISYHYRKITKSLNLAFRGTSSRVANRLKVGSVGRHTAIKGISDLDMLYIMPPNQYEYYNHKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALDAEGAASENDRWRKVFGRAFPRRKVDIMEARLALESHAADAAPWADTEEFIEEKYPVDIKYSLNLDCTVTQDGFPPRSLREMLTRRFRLSARKSLLFRADLTEMEAEEPYTVMWKVLNVGDEARRRNMIRGQIVPDGGYYTKKETTDFRGDHVVECYVIKNEVVVARAQIEVPIS

SEQ ID NO: 5616 - protein, 442 aa, Klebsiella pneumoniae
MSRRELFSEFLENLNLDLKQAKKISYHYRKITKSLNLAFRGTSSRVANRLKVGSVGRHTAIKGISDLDMLYIMPPNQYEYYNHKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALDAEGAASENDRWRKVFGRAFPRRKVDIMEARLALESHAADAAPWADTEEFIEEKYPVDIKYSLNLDCTVTQDGFPPRSLREMLTRRFRLSARKSLLFRADLTEMEAEEPYTVMWKVLNVGDEDRRRNMIRGQIVPDGGYYTKKETTDFRGDHVVECYVIKNEVVVARAQIEVPIS

SEQ ID NO: 5617 - protein, 424 aa, Klebsiella variicola
MSRRELFSEFLENLNLDLKQAKKISYHYRKITKSLNLAFRGTSSRVANRLKVGSVGRHTAIKGISDLDMLYIMPPNQYEYYNHKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALDAEGAASENDRWRKVFGRAFPRRKVDIMEARLALESHAADAAPWADTEEFIEEKYPVDIKYSLNLDCTVTQDGFPPRSLREMLTRRFRLSARKSLLFRADLTEMEAEEPYTVMWKVLNVGDEARRRNMIRGQIVPDGGYYTKKETTDFRGDHGKRTA

SEQ ID NO: 5618 - protein, 442 aa, Klebsiella pneumoniae
MSRRELFSEFLENLNLDLKQAKKISYHYRKITKSLNLAFRGTSSRVANRLKVGSVGRHTAIKGISDLDMLYIMPPNQYEYYNHKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLAKDFFEYLSNEERRERYLALGSNQYVRVKSPWFGRAAKHAYELCCDALDAEGAASENDRWRKVFGRAFPRRKVDIMEARLALESHAADAAPWADTEEFIEEKYPVDIKYSLNLDCTVTQDGFPPRSLREMLTRRFRLSARKSLLFRADLTEMEAEEPYTVMWKVLNVGDEARRRNMIRGQIVPDGGYYTKKETTDFRGDHVVECYVIKNEVVVARAQIEVPIS

SEQ ID NO: 5619 - protein, 442 aa, Enterobacter cloacae
MSRRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALDAEGAASENDRWRKVFGRAFPRRKVDIMEARLALESHAADAAPWADTEEFIEEKYPVDIKYSLNLDCTVTQDGFPPRSLREMLTRRFRLSARKSLLFRADLTEMEAEEPYTVMWKVLNVGDEARRRNMIRGQIVPDGGYYTKKETTDFRGDHVVECYVIKNEVVVARAQIEVPIS

SEQ ID NO: 5620 - protein, 442 aa, Enterobacter cloacae
MSRRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALNAEGAASENDRWRKVFGRAFPRRKVDIMEARLALESHAADAAPWADTEEFIEDKYPVDIKYSLNLDCTVTQDGFPPRSLREMLTRRFRLSARKSLLFRADLTEMEAEEPYTVMWKVLNVGDEARRRNMIRGQIVPDCGYCTKKEATDFRGDHVVECYVIKNEVVVARAQIEVPIS

SEQ ID NO: 5621 - protein, 442 aa, Salmonella enterica
MSRRELFSEFLENLNLDLKQAKKISYHYRKITKSLNLAFRGTSSRVANRLKVGSVGRHTAIKGISDLDMLYIMPPNQYEYYNRKDNGQSALLTDVRNILAEEYPDQTVKKDRLVVQVVFKNFHVEVQPVFRQDDGSFKFPESYNGGAWRITKPLHEKAAMTAFSRDKSNNLRKLCKMIRAWKNLHGVNMGGLLIDTLAYRFLSSTSDYDNTGNGSLGVLARDFFEYLSNEERRERYLALGSNQYVRVKSPWFGRAAKHAYELCCDALDAEGAASENDRWRKVFGRAFPRRKVDIMEARLALESHAADAAPWADTEEFIEDKYPVDIRYSLNLDCTVTQDGFPPRSLREMLTRRFRLSTRKSLLFRADLTEMEAEEPYIVMWKVLNVGDEARRRNMIRGQIVPDGGYCTKKETTDFRGDHVVECYVIKNEVVVARAQIEVPIS

SEQ ID NO: 5622 - protein, 442 aa, Enterobacter cloacae
MSRRELFSEFLENLNLDLKQAKKISYHYRKITKSLNLAFRGTSSRVANRLKVGSVGRHTAIKGISDLDMLYIMPPSQYEYYNRKDNGQSALLTDVRNILAEEYPGQTVKKDRLVVQVVFKNFHVEVQPVFRQDDGSFKFPESYNGGAWRITKPLHEKAAMTAFSRDKSNNLRKLCKMIRAWKNLHGINMGGLLIDTLAYRFLSSTSDYDNTGNGSLGALARDFFEYLSNEERRERYLALGSNQYVRVKSPWFGRAAKHAYELCCDALDGEGAASENDRWRKVFGRAFPRRKVDIMEARLGLESHAADAAPWADTEEFIEDKYPVDIRYSINLDCTVTQDGFPPRSLREMLTRRFRLSARKSLLFRVDLTEMEAEEPYIVMWKVLNVGDEARRRNMIRGQIVPDGGYCTKKETTDFRGDHVVECYVIKNEVVVARAQIEVPIS

SEQ ID NO: 5623 - protein, 442 aa, Citrobacter freundii
MSHRELFSEFLDNLNLDLKQAKKISYHYRKITKSLNLAFRGTNSRVANRLKVGSVGRHTAIQGISDLDMLYIMPPNQYEYYNRKDNGQSALLTDVRNILAEEYPNQTVKKDRLVVQVVFKNFHVEVQPVFKQDDGSFKFPESYNGGAWRITKPLHEKAAMTEFSRDKSNNLRKLCKMVRAWKNLHGVNMGGLLIDTLAYRFLSSTSDYDNTGNGRLGYLSRDFFEYLSNEEKRERYLALGSNQYVRVKSPWFGRAAKHAYELCCDALDAEGAASENDRWRKVFGRAFPRRKVDVFEARLGLESRATDATGWADTEEFIENKYPVDIRYSLNLDCTVTQDGFSPRSLREMLTRRFRLSARKSLLFRADLTEMEAEEPYTVMWKVLNVGGEARRRNMIRGQIVPDAGYCTKKESTDFRGDHVVECYVIKNEVMVARAQIEVPIS

SEQ ID NO: 5624 - protein, 442 aa, Escherichia coli
MSHRELFSEFLGNLKLDLKQAKRISYHYRKITKSLNIAFRETDSSIANRLKVGSVGRHTAIKGISDLDMLYIMPGSKYEYYNSKDNGQSALLTDVRNILARKYPEQTVRKDRLVVQVIFKNFYVEVQPVFKQNDGSFKYPDSYNGESWKITKPLHEKAAMTEFSRDKSNNLRKLCKMIRAWKNRHGVNMGGLLIDTLAYRFLSSTSKYDNTGNGSLGVLAKEFFEYLSNEEKHERYLALGSNQHVSVKSPWFGRAAKQAYELCCDALDAAGTVCENDCWRAVFGRAFPKLKADILESNLSLASCATDVATWNDTEEFIEDKYPVDIKYSLNLDCTVTQNGFKPTKLRKMLSRGFRLSARKSLLFQVDLAEGEIEEPYTVMWKVLNVGDEARRRNMIRGQIVQDKGHCTKKESTDFRGDHMVECYVIKNEVVVARAQIDVPIN

SEQ ID NO: 5625 - protein, 427 aa, Gilliamella apicola
MSVTDMFKEFLANLKIDNSEQITSRYEEITCCLNKKYRCSDAKTSNRLQIGSYGRWTAIKGISDLDMLYIMPNSKWYDYQNSGGQSKLLKEVKDVIQRRYPTTEVKVDRLVVTVTFNNFYIEVQPVFELDDGNFQYPDTYDGGSWKITKPREEISAMKEFVDNKNNNLRCLCKMVRAWKNNHGIAMGGLLIDTLAYNFLNSNTYYDDKSFSYYNHLSKDFFEFLKDQGDQDYYLALGSRQQVKVKKKFQQAAKKAYEMCLDAIDSGGNDIAYDKWRKIYGSAFPCRPKQLSESRAQLSYNFSNTEEFIEDKYPIDIRYSFKLDCIVTQNGFRPFRLSSHTRRLSVNKRLNFVASDIDVPEPYIIKWKILNIGQEAERRDCIRGQILNDNGNKEKIESTSFTGDHLVECYVIKNNIVVAKENIIVPIE

SEQ ID NO: 5626 - protein, 427 aa, Gilliamella apicola
MSVTDMFKEFLANLKIDNSEQITSRYEEITCCLNKKYRCSDAKTSNRLQIGSYGRWTAIKGISDLDMLYIMPNSKWYDYQNSGGQSKLLKEIKDVIQRRYPTTEVKVDRLVVTVTFNNFYIEVQPVFELDDGNFQYPDTYDGGSWKITKPREEISAMKEFVDNKNNNLRCLCKMVRAWKNNHGIAMGGLLIDTLAYNFLNSNTYYDDKSFSYYNHLSKDFFEFLKDQGDQDYYLALGSRQQVKVKKKFQQAAKKAYEMCLDAIDSGGNDIAYDKWRKIYGSAFPCRPKQLSESRAQLSYNFSNTEEFIEDKYPIDIRYSFKLDCIVTQNGFRPFRLSSHTRRLSVNKRLNFVASDIDVPEPYIIKWKILNIGQEAERRDCIRGQILNDNGNKEKIESTSFTGDHLVECYVIKNNIVVAKENIIVPIE

SEQ ID NO: 5627 - protein, 224 aa, Klebsiella pneumoniae
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFQVYS

SEQ ID NO: 5628 - protein, 437 aa, Klebsiella pneumoniae
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFKYIHELEEQTEYSAPGSRQRVKVKKKFQKKAKKAYHLCLEAIDASGQSNENDKWKKVYGRPFPKAETVSKASLSIHTHATWKNTEEFIEDKFPVDIKENIKIDCEVKQNGFREFFLRDMISRHIPLRNKKDLRFEVKEISVIQPYDIYWKVLNRGEVAKRKNNIRGQIVADAGMRQKIESTNFRGDHIVECYCVKDGVVVAKDRIHVPIVIEGNRDE

SEQ ID NO: 5629 - protein, 438 aa, Klebsiella pneumoniae
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFKYIHELEEQTEYSAPGSRQRVKVKKKFQKKAKKAYHLCLEAIDASGQSNENDKWKKVYGRPFPKAETVSKASLSIHTHATWKNTEEEFIEDKFPVDIKENIKIDCEVKQNGFREFFLRDMISRHIPLRNKKDLRFEVKEISVIQPYDIYWKVLNRGEVAKRKNNIRGQIVADAGMRQKIESTNFRGDHIVECYCVKDGVVVAKDRIHVPIVIEGNRDE

SEQ ID NO: 5630 - protein, 437 aa, Klebsiella pneumoniae
MTISEMFSGFISNLSINNAETISSRYGELTTALNKQFRDTESNIANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFKYIHELEEQTEYSAPGSRQRVKVKKKFQKKAKKAYHLCLEAIDASGQSNENDKWKKVYGRPFPKAETVSKASLSIHTHATWKNTEEFIEDKFPVDIKENIKIDCEVKQNGFREFFLRDMISRHIPLRNKKDLRFEVKEISVIQPYDIYWKVLNRGEVAKRKNNIRGQIVADAGMRQKIESTNFRGDHIVECYCVKDGVVVAKDRIHVPIVIEGNRDE

SEQ ID NO: 5631 - protein, 437 aa, Klebsiella aerogenes
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFKYINELEEQTEYSAPGSRQRVKVKKKFQKKAKKAYHLCLEAIDANGQSNENDKWKKVYGRPFPKAETVSKASLSIHTHATWKNTEEFIEDKFPVDIKENIKIDCEVKQNGFREFFLRDMISRHIPLRNKKDLRFEVKEISVIQPYDIYWKVLNRGEVAKRKNNIRGQIVADAGMRQKIESTNFRGDHIVECYCVKDGVVVAKDRIHVPIVIEGNRDE

SEQ ID NO: 5632 - protein, 437 aa, Trabulsiella odontotermitis
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLNSTTEYDDKSYHYYDWLSRDFFKYIHELEEQTEYSAPGSRQRVKVKKKFQKKAKKAYHLCLEAIDANGQSNENDKWKKVYGRPFPKAETVSKASLSIHTHATWKNTEEFIEDKFPVDIKENIKIDCEVKQNGFREFFLRDMISRHIPLRNKKDLKFEVKEISVIQPYDIYWKVLNRGEVAKRKNNFRGQIVADAGMRQKIESTNFRGDHIVECYCVKDGVVVAKDRIHVPIVIEGNRDE

SEQ ID NO: 5633 - protein, 437 aa, Citrobacter koseri
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDVNKNSNLRRLCKMIRAWRNKHGLAMGGLLIDTLVYNFLDSTTEYDDKSYHYYDWLSRDFFKYIHELEEQTEYSAPGSRQRVKVKKKFQKKAKKAYHLCLEAIDANGQSNENDKWKKVYGRPFPKAETVSKASLSIHTHATWKNTEEFIEDKFPVDIKENIKIDCEVKQNGFREFFLRDMISRHIPLRNKKDLRFEVKEISVIQPYDIYWKVLNRGEVAKRKNNIRGQIVADAGMRQKIESTNFRGDHIVECYCVKDGVVVAKDRIHVPIVIEGNRDE

SEQ ID NO: 5634 - protein, 437 aa, Klebsiella michiganensis
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVFEQEDCSYKYPDTKNGGSWKITKPRAEMTAINNLDANKNSNLRRLCKMIRAWRNKHGLAMGGLLIDTLVYNFLDSTTEYDDKSYHYYDWLSRDFFKYIHELEEQTEYSAPGSRQRVKVKKKFQKKAKKAYHLCLEAIDANGQSDENDKWKKVYGRPFPKAETVSKASLSIHTHATWKNTEEFIEDKFPVDIKENIKIDCEVKQNGFREFFLRDMISRHVPLRNKKDLRFEVKEISVTQPYDIYWKVLNRGEVAKRKNNIRGQIVEDAGMRQKIESTNFRGDHIVECYCVKDGVVVAKDRIHVPIVIEGNRDE

SEQ ID NO: 5635 - protein, 126 aa, Klebsiella pneumoniae
MTISEMFSGFISNLSINNAETISSRYGELTTALNKQFRDTESNTANTLQVGSFGRKTGIRGISDLDMLYIMPKSKWDNYKDGKQLELLQDVKSAILKRYPTTKVRVDRLVVTVTYTNFHVEVQPVF

SEQ ID NO: 5636 - protein, 434 aa, Limnohabitans sp.
MSIADMFSEFIGNLVIFNAETISLRYGELTAALNKQFRDTESKTANTLQVGSFGRKTGINGISDLDMLFIMPKTKWDDYNKVGGQLKLLQDAKEAIVNRYPTTKVRVDRLVVTVTYKDFHVEVQPVFEQDDNSYKYPDTANGGNWKITKPREEMDAIADLDTLKNSNLRRLCKMARAWKNKHGVGMGGLLIDTLAYKFLDSTSDYDEKSFLYYDFLSRDFFKYLSELPEQTEYAAPGSRQRVKVKRKFQKKAKKAYSLCLEAIDAEEQKNVNEKWKKVYGRPFPAAKEATVRMAARSWRDTEEFIEDRFPIDIREYLNIDCEVKQNGFRKFILRDLLRLRFPLRAKKDLLFYVSEVSVAEPYKIYWKVLNRGVEAIRRDSIRGQIVEDDGSMRRSEKTQFMGEHIVECYCVMDGVVVAKDRIHVPIVADGSDYD

SEQ ID NO: 5637 - protein, 430 aa, Unknown
  Description of Unknown: Bathymodiolus platifrons methanotrophic gill symbiont sequence
MSVSEMFSEFIGNLAISNTTTISTRYGEITSALNKKFRDTESKTDNTLQVGSFGRKTGINGISDLDMLYIMPKTKWDTYNKYDGQLKLLQDTKTAILKRYPSTKVRVDRLVVTVTYTNFHVEVQPVFEQDDDSFKYPDTSNGGSWKITKPKEEMSAIADLNLRRLCKMARSWKNKHGVAMGGLLIDTLAYNFLNSTSDYDSRSYAFYHWLSRDFFKYLSELPKKTKYSAPGSRQDVKVKKPFQRKAKKAYKLCREAIEAENNKNVNDKWKKVYGRPFPAATEETTKSRSFTDTWRNTEEFIEDKFNIDIREFLRIDCEVKKNGFRQYFLSEKSSSRFKLGVNKSLRFTVTKLSVTEPYQIYWKVLNRGDVARKRNMIRGQIVPDLGHEELTESTSFRGDHIVECYCVKDGVVVAKDRIKVPIGSEGNEND

SEQ ID NO: 5638 - protein, 147 aa, Dichelobacter nodosus
MSVAKMFSNFIDNLAVSNREMISMRYGELTSALNKQFRNTESKTANTLQIGSFGRKTGINGISDLDMLYIMPKNKWDIPLESIRARRDALLDELHAVYAKAPSTNFKAYSNAQKSLKKLEDMTFSDEEIDAFLPKELKKVSKGSSNV

SEQ ID NO: 5639 - protein, 147 aa, Dichelobacter nodosus
MSVAKMFSNFIDNLAVSNREMISMRYGELTSALNKQFRNTESKTANTLQIGSFGRKTGINGISDLDMLYIMPKNKWDIPLESIRARRDALLDELHAVYARAPSTNFKAYSNAQKSLKKLEDMTFSDEEIDAFLPKELKKVSKGSSNV

SEQ ID NO: 5640 - protein, 437 aa, Thioalkalivibrio versutus
MKVSEMFSGFVSNLAITNTNTISFRYGELTSALNRRFRDTDSKTANTLQVGSFGRKTGINGISDLDMLYIMPKGKWEDYKDGMQLKLLQDTKSAILSRYPSTNVRVDRLVVTVTYTNFHIEVQPVFEQTDRSYLYPDTKNGGSWKVTKPREEMEAVSEMDSDKNANLRRLCKMARAWRNQHGVAMGGLLIDTLAYKFLDGNTEYDNRGYAYYDWLSRDFFKFLSDLSEQSEYAAPGSRQRVKVKKKFQRKAKKAYKLCLKAIDAEGQRGVHGKWKKVYGRPFPAATVDTQKALDEATQASWENTEEFIEDGYAVDISGSLRIDCEVKQNGFREFFLRNMLMRKIPLMAKKSLRFYVTEISVREPYELYWKVLNRGDEARRRNCIRGQIKEDAGQMQREETTDFRGDHVVECYCVKDGVVVAKDRLHVPIVAEAGANE

SEQ ID NO: 5641 - protein, 437 aa, Thioalkalivibrio halophilus
MTVSEMFSGFVSNLAITNTDTISFRYGELTSALNRQFRDTDSKTANTLQVGSFGRKTGINGISDLDMLYIMPKGKWDDYKDGKQLKLLQDTKSAILSRYPSTNVRVDRLVVTVTYTNFHIEVQPVFEQTDRSYLYPDTKNGGSWKFTKPREEMEAVSEMDSAKNANLRRLCKMARAWRNQHGVAMGGLLIDTLAYKFLDQTTEYDSRGYAYYDWLSRDFFKFLSDLPEQSEYGAPGSRQRVKVKKKFQRKAKKAYKLCLKAIEAEGQRGVNGKWKKVYGRPFPAATVDTQKALDEAVQASWDNTEEFIEDRYAVDISGSLRIDCEVKQNGFREFFLRTMLMRKIPLMAKKSLRFYVTEISVREPYEIYWKVLNRGDEARRRNCIRGQIKEDAGQMQKEETTDFRGDHVVECYCVKDGVVVAKDRLHVPIVAEAGANE

SEQ ID NO: 5642 - protein, 433 aa, Vibrio cholerae
MFSDFVGNLAIGNTEIISTRYGELTSALNKQYRDTESKTANTLQVGSFGRKTGINGISDLDMLYIMPKTKWADYNKAGGQLSLLQDAKDAILKRYPTTKVKVDRLVVTVTYTNFHVEVQPVFEQDDQSYLYPDTKNGGSWKTTKPRAEMTAVAELDAKKNANLRPLCKMARAWKNKHGVGMGGLLLDTLAYNFLDSTTDFDTRSFLYYDWMSRDFFKYLSELPEQTEYAAPGSHQRVRVKKKFQKKAKKAHKLCVEAIEAENQKNVNDKWKKVYGRPFPASATVAQEAVAKSFAQSWDDTEEFIEDKFPVDIRESMQLDCEVKQNGFREFFLRDMLARRIPLMTKKSLRFEIKGISAVKPYDIYWKVLNRGDAARKRNCIRGQIIKDDGLMQRTESTSFLGDHIVECYCVKDGVVVAKNRIHVPIDGEQNSDD

SEQ ID NO: 5643 - protein, 438 aa, Vibrio cholerae
MSVAEMFSDFVGNLAIGNTEIISTRYGELTSALNKQYRDTESKTANTLQVGSFGRKTGINGISDLDMLYIMPKTKWADYNKAGGQLSLLQDAKDAILKRYPTTKVKVDRLVVTVTYTNFHVEVQPVFEQDDQSYLYPDTKNGGSWKTTKPRAEMTAVAELDAKKNANLRPLCKMARAWKNKHGVGMGGLLLDTLAYNFLDSTTDFDTRSFLYYDWMSRDFFKYLSELPEQTEYAAPGSHQRVRVKKKFQKKAKKAHKLCVEAIEAENQKNVNDKWKKVYGRPFPASATVAQEAVAKSFAQSWDDTEEFIEDKFPVDIRESMQLDCEVKQNGFREFFLRDMLARRIPLMTKKSLRFEIKGISAVKPYDIYWKVLNRGDAARKRNCIRGQIIKDDGLMQRTESTSFLGDHIVECYCVKDGVVVAKNRIHVPIDGEQNSDD

SEQ ID NO: 5644 - protein, 438 aa, Vibrio cholerae
MSVAEMFSDFISNLAISNTETISTRYGELTAALNKQFRDTESKTANTLQVGSFGRKTGINGISDLDMLYIMPKTKWSDYNKAGGQLSLLQDAKEAILKRYPTTKVKVDRLVVTVTYTNFHVEVQPVFEQDDQSYLYPDTKNGGSWKTTKPRAEMTAVADLDTKKNANLRPLCKMARAWKNKHGVGMGGLLLDTLAYNFLASTTDFDTKSFLYYDWLSRDFFKYLSELPEQTEYAAPGSRQRVKVKKKFQKKAQKAHKLCVEAIEADNQKNVNDKWKKVYGRPFPASATVAQEAVAKSFAQGWDDTEEFIEDKFPVDIRESMQLDCEVKQNGFREFYLRDMLARRIPLMTKKSLRFEITGVSVAKPYDIYWKVLNRGDAARKRNCIRGQIIKDDGLMQRTESTSFLGDHIVECYCVKDGVVVAKNRIHVPIDGEQNSDD

SEQ ID NO: 5645 - protein, 438 aa, Aeromonas hydrophila
MSVAQMFSDFVGNLAIGNAETISTRYGELTAALNKQFRDTESKTANTLQVGSFGRKTGINGISDLDMLYIMPKTKWADYNKAGGQLSLLQDAKDAILKRYPTTKVKVDRLVVTVTYTNFHVEVQPVFEQDDQSYLYPDTKNGGSWKTTKPRAEMTAMADLDTKKNANLRPLCKMARAWKNKHGVGMGGLLLDTLAYNFLDSTTDFDTKSFLHYDWMSRDFFKYLSELPEQTEYAAPGSRQRVKVKKKFQKKAKKTYKLCLEAIEAEHQKNVNDKWKKVYGRPFPASATVAQEAMAKSFAQSWDDTEEFIEDKFPVDIRESMQLDCEVKQNGFREFFLSDMLARRIPLMTKKSLRFEITDVSVPEPYDIYWKVLNRGDAARKRNCIRGQIIKDDGLMQRTESTSFRGDHIVECYCVKDGVVVAKNRIHVPINGEQNNDD

SEQ ID NO: 5646 - protein, 438 aa, Acidovorax sp.
MSVAEMFSDFVRNLAISNAETISARYGELTSALNKQFRDTESKEANTLQVGSFGRKTGINGISDLDMLYIMPKSKWADYNKAGGQLSLLQDAKEAILKRYPTTKVKVDRLVVTVTYTNFHVEVQPVFEQDDQSYLYPDTKNGGSWKTTKPREEMAAVADMDVQKNANMRRLCKMARAWKNKHGIAIGGLLLDTLAYNFFDSTTDYDTKSFLYYDWMSRDFFKYLSELPEQTEYAAPGSRQRVKVKKKFQKKAKKAHKLCVEAIAAENQKNVNDKWKKVYGRPFPASATVTQEAVAKSFAQGWDDTEEFIEDKFPIDIRESMQLDCEVKQNGFREFFLREMLARRIPLMTKKSLRFEITGVSAAKPYDIYWKVLNRGDAARKRNCIRGQIIKDDGLMQRTESTSFLGDHIVECYCVKDGVVVAKNRIHVPINGEQNNDD

SEQ ID NO: 5647 - protein, 435 aa, Thermomonas fusca
MTVAEMFSEFLGNLAITNTETISARYGELTCALNKQFRDTESREANTLQVGSFGRRTGINGISDLDILYIMPKSKWEDYNNSGGQLKLLQDAKEAILNRYPTTQVRVDRLVVTVTYTNFHVEVQPVFEQDDQSYKYPDTKNGGSWKITKPREEMKAVADMDVAKNANLRRLCKMVRAWKNKHGVSMGGLLIDTLAYNFLNSTTAYDTKSFLYYDELSRDFFKFLSDQPDQDEYAAPGSRQRVRVKKKFQRKARKAYDLCIQAISAEGQTNVNEKWKGVYGRPFPSAGGKVEKAFTSPTWDNTEEFIEDKFSVDIRGHLKLDCEVKQNGFRKFFLSDMLLRHIPLKSSKKLHFWVKDLSVRAPYKIYWRVLNRGGEAEKRNCIRGQIVLDGGHLDKNEETSFRGDHVVECYCVKDGVVVAKDRIHVPIEADASDYD

SEQ ID NO: 5648 - protein, 436 aa, Unknown
  Description of Unknown: Pseudomonas sequence
MSVAEMFSEFIGNLAISNAETISMRYGELTAALNKQFRDTESKTANTLQVGSFGRRTGINGISDLDMLYIMPQTKWDDYDKIGGQLKLLQDTKDAILKRYPSTKVRVDRLVVTVTYTNFHVEVQPVFEQDDKSYKYPDTKNGGSWKVTKPREEMDAVANLDAVKNSNLRRLCKMVRAWKNKHGIGIGGLLIDTLAYNFLNSTSDYDEKSYLYYDWLSRDFFKYISELPDQSEYAAPGSRQRVKVKKKFQRRAKKAYELCLKAIEAEGKESANEKWKAVYGRPFPAAQKKSAEASAAQTWKDTEEFIEDKFQVDIRYQLKIDCEVMQRGFRKFLLRNMLGLKIPLRSDKKLKFWVSELPQINGPFLIYWKVLNRGDEARRRDCVRGQITLDGGWRTKEESSNFRGDHIVECYLVENETVVAKDRIHVPIVADGSDYD

SEQ ID NO: 5649 - protein, 436 aa, Bordetella parapertussis
MSVAEMFSEFIGNLAISNAETISMRYGELTAAFNKQFRDTESKTANTLQVGSFGRRTGINGISDLDMLYIMPKTKWDDYDKVGGQLKLLQDTKDAILKRYPSTKVRVDRLVVTVTYTNFHVEVQPVFEQYDKSYKYPDTKNGGSWKVTKPREEMDAVANLDAVKNSNLRRLCKMVRAWKNKHGIGIGGLLIDTLAYNFLNSTSDYDEKSYLYYDWLSRDFFKYISELPDQSEYVAPGSRQRVKVKKKFQRRAKKAYELCLKAIEAEGKESANEKWKAVYGRPFPAAQKKLAEASAEQTWKDTEEFIEDKFQVDIRYQLKIDCEVMQRGFRKFLLRNMLGLKIPLRSDKKLKFWVSELPQINGPFLIYWKVLNRGDEARRRDCVRGQITLDGGWRTKEESSNFRGDHIVECYLVENETVVAKDRIHVPIVADGSDYD

SEQ ID NO: 5650 - protein, 434 aa, Idiomarina zobellii
MFSDFVGNLAISNTSTISLRYGEITSALNKQFRDSESKTSNTLQVGSFGRKTGINGISDLDMLYIMPKSKWETYNTSGGQSKLLKDTKNAILKRYPSTNVRVDRLVVTVTYTNFQVEVQPVFEQDDCSYKYPDTKNSGSWKITKPRDEMDAVNELNTQKNSNLKRLCKMARAWRNQHGMAMGGLLIDTLAYNFLNSTNEYDTRSYSFYDWMSRDFFKYLSELPDQNEYAAPGSRQRVKVKKKFQKKAQKAYKLAKDAIESSGTESENNKWKKLYGRPFPAADKLSKEELGANQKKSWTNTEEFIEDKFSVDIRYQLRIDCEVMQRGFRKFQLREMLDRKIPLKADKKLRFWVKEFPLIGGSSQVYWKVLNRGDVAKKRDCIRGQIVPDGGRRMKEEKSDFLGEHIVECYLVQNNVVVAKDRIHVPIIADGSDYE

SEQ ID NO: 5651 - protein, 439 aa, Idiomarina zobellii
MSTSEMFSDFVGNLAISNTSTISLRYGEITSALNKQFRDSESKTSNTLQVGSFGRKTGINGISDLDMLYIMPKSKWETYNTSGGQSKLLKDTKNAILKRYPSTNVRVDRLVVTVTYTNFQVEVQPVFEQDDCSYKYPDTKNSGSWKITKPRDEMDAVNELNTQKNSNLKRLCKMARAWRNQHGMAMGGLLIDTLAYNFLNSTNEYDTRSYSFYDWMSRDFFKYLSELPDQNEYAAPGSRQRVKVKKKFQKKAQKAYKLAKDAIESSGTESENNKWKKLYGRPFPAADKLSKEELGANQKKSWTNTEEFIEDKFSVDIRYQLRIDCEVMQRGFRKFQLREMLDRKIPLKADKKLRFWVKEFPLIGGSSQVYWKVLNRGDVAKKRDCIRGQIVPDGGRRMKEEKSDFLGEHIVECYLVQNNVVVAKDRIHVPIIADGSDYE

SEQ ID NO: 5652 - protein, 437 aa, Snodgrassella sp.
MSTCKIFSQFVQNLFIQNIETISTRYGELTTALNRQFRDTDSKTANTLQVGSFGRKTGINNISDLDMLYIMPESKWKNYNTSGGQLKLLQDTKEAISKRYPKTKVQVDRLVVTVTYTNFHIEVQPVFEQDDGSYKYPDTKNGGSWKFTKPKEEMEAVNSLNKEKNLNLKRLCKMVRAWKNKHGIEMGGLLIDTLAYNFLTSTPEYDDKSYSDYDCLSRDFFKYISELPDQKEYAAPGSRQRVKVKKKFQQRAKKAYELCLKAIEAEEKNNNVNEKWKAVYGRPFPAAQEQISKASISQTQITTEEFIEDKFPVDICCQVKIDCEVTQNGFRKFLLRDMLEMRIPLKAKKKLKFRVSEWPQVEEPFQIYWKVLNRGEEAQRRNCVRGQIVLDSGQRVKEESSDFQGDHVVECYLVKNNIVVAKDRIHVPIVADGSDYD

SEQ ID NO: 5653 - protein, 436 aa, Xanthomonas vasicola
MSVADMFSGFLGNLAVDNLETISLRYGELTAALNKKFRDTESKTDNTLQVGSFGRKTGIKDISDLDMLHIMPKGKWTEYNKAGGQSKLLEHARDAIKERYPNTRVRVDRLVVTVTYKDFHIEVQPVFEQDDGSYKYPDTKGGGSWKITKPREEMAAVATLDDMKNCNLRRLCKMARAWKNKHGVGIGGLLIDTLAYNFLNSTNDYDTKSYLYYDWMSRDFFKYLSELEEQDEYAAPGSRQRVRVKKKFQKKANKGYQLCLDAMASEKTEKANENWKKVYGRPFPAGQEKSALAKDAKSWKDTEEFIEDRFSIDVREDMKIDCDVKQRGFRKYTLRDLIKRGLPLWSKKTLEFRLVRPLNLGPVYELFWKVLNRGAEAERRDCIRGQIVRDGGHLMKTESTTFQGEHIVEAYIVRDGVVVAKDRIHVPIRNGSRDYD

SEQ ID NO: 5654 - protein, 436 aa, Xanthomonas vasicola
MSVADMFSGFLGNLAVDNLETISLRYGELTAALNKKFRDTESKTDNTLQVGSFGRKTGIKDISDLDMLHIMPKGKWTEYNKAGGQSKLLEHARDAIKERYPNTRVRVDRLVVTVTYKDFHIEVQPVFEQDDGSYKYPDTKGGGSWKITKPREEMAAVATLDDMKNCNLRRLCKMARAWKNKHGVGIGGLLIDTLAYNFLNSTNDYDTKSYLYYDWMSRDFFKYLSELEEQDEYAAPGSRQRVRVKKKFQKKANKGYQLCLDARASEKTEKANENWKKVYGRPFPAGQEKSALAKDAKSWKDTEEFIEDRFSIDVREDMKIDCDVKQRGFRKYTLRDLIKRGLPLWSKKTLEFRLVRPLNLGPVYELFWKVLNRGAEAERRDCIRGQIVRDGGHLMKTESTTFQGEHIVEAYIVRDGVVVAKDRIHVPIRNGSRDYD

SEQ ID NO: 5655 - protein, 436 aa, Xanthomonas campestris
MSVAEMFSGFLGNLAVDNSETISLRYGELTAALNKKFRDTESKTDNTLQVGSFGRKTGIKGISDLDMLYIMPKGKWTEYNKAGGQFKLLEHAREAIKERYPNTRVRVDRLVVTVTYKDFHIEVQPVFEQGDGSYKYPDTKSGGSWKITKPREEMAAVAILDDLKNCNLRRLCKMARAWKNKHGVGIGGLLIDTLAYNFLKSTNSYDTKSYLYYDWMSRDFFKYLSELEEQDEYAAPGSRQRVRVKKKFQKKANKGYQLCIDAIASEKTEKANEKWKKVYGKPFPAGQEKSVLAKDAKSWKDTEEFVEDRFSIDVREDMKIDCDVKQRGFRKHTLRDLIKRGLPLWSEKTLEFRLVRPVHLGPGYELFWKVLNRGSEAERRDCIRGQIVRDAGHLIKTESTTFQGEHIVEAYIVRDGVVVAKDRIHVPIRNGSRDYD

SEQ ID NO: 5656 - protein, 436 aa, Pseudomonas taeanensis
MGVGEMFSEFLGNLLVDNTATISARYGELTCALNKEFRDTESKTANTLQVGSFGRSTGIKGISDLDMLYIMPKSKWDDYNKTGGQTRLLEDARKAIKDRYPTTKVRVDRLVVTVTYQDFHVEVQPVFEQDDGSYKYPDTKNGGSWKITKPREEMDAVATLDGKKNHNLRPLCKMARAWKNKHGVSMGGLLIDTLAYNFLSSTTEYDSQSYFYYDWMSRDFFKYLSELPEQTEYAAPGSRQRVRVKKKFQKKAKKAYDLCVTAIDAEKSANVNDKWKKVYGRPFPASKERVAVATVARAWRNTEQFIEDLFPVDVREDLKVDCDVKQRGFRKFSLRDMLSRAIPLRSEKNLEFRMTRPLALDPGCQLYWKVQNRGPEAEQRDCIRGQIELDRGHYMKCESTSFRGDHIVEAYLVRDGVVVAKDRIHVPIVNDGRDYD

SEQ ID NO: 5657 - protein, 436 aa, Pseudomonas chlororaphis
MGVGEMFSEFLGNLIVDNTETISTRYGELTCALNKKFRDTESKTANTLQVGSFGRSTGIKGISDLDMLYIMPKNKWDNYNKAGGQTSLLEDARKAIKDRYPTTKVRVDRLVVTVTYQGFHVEVQPVFEQDDGSYKYPDTKNGGSWKITKPREEMDAVATLDDRKNHNLRRLCKMARAWKNKHGVSMGGLLIDTLAYSFLSSTTEYDSRSYLYYDWMSRDFFKYLSELPEQTEYAAPGSRQRVRVKKKFQKKAKKAYDLCVVAIEAEKNANVNDKWKKVYGRPFPASKERVAIASAARGWRNTEQFIEDLFPVDVREDLKIDCDVNQRGFRKFALRDMLSRAIPLRSEKSLEFRMTQPLALDPGCQLYWKVLNRGSEAEQRDCIRGQIELDRGHDMKRESTSFRGDHIVEAYLVRDGVVVAKDRIHVPIVNDGRDYD

SEQ ID NO: 5658 - protein, 446 aa, Xanthomonas arboricola
MELKKKLEGLWEMSVSEMFADFLTNLKVSNAETISLRYGELTAALNKHFRDTESKEANTLQVGSFGRKTGIDGISDLDMLYIVPQAKWDEYDKKKGQLKLLQDTRDAILKRYPKTRVRVDRLVVTVTYSNFHVEVQPVFALDDGSYKYPDTKSDGSWKITKPRQEMTAVAKMDEDKNCNLRRLCKMARAWKNKHGVAMGGLLIDTLAYNFLEATKTYDSKSYLYYDELSRDFFKFLADEPDQDTYWAPGSRQHVKVKKRFQRKAKKAYEFCLKAIEADGEDGVHEKWKKVFGRPFPSGTKAAVEDVAFTWDNTEEFIEDRFAVDITKSLILDCDVKQNGFRKFYLSDLIKRKMPLKANKVLRFWIKELNVDGPYEIYWKVLNRGVEAEKRNIIRGQILPDGGYRQKQETSDFRGDHVVECYCVINGVVVAKDRIHVSIDSDTGDYD

SEQ ID NO: 5659 - protein, 437 aa, Thiohalocapsa sp.
MSVSEMFSEFIANLAISNAGTVSYRYGELTSALNKQFRDTESKTANTLQVGSFGRKTGIDGISDLDMLYIMPKSIWDDYKEGKQLKLLQDTKAAILKRYPNTNVRVDRLVGTVTYTDFHVEVQPVFEQEDQSYYYPDTKGDGSWKVTKPRKEMAAVSELDADKNYNLKRLCKMARAWKNKHGVGMGGLLIDTLAYNFLKSTTDYDDKSYLYYDWMSRDFFKYLSELPKQDYYAAPGSGQRVKVKKNFQAKAKKAYNLCLDATNAEKQKNVNAKWKKVYGRPFPAAKEEVAEAPVAKAAYTWKDTEQLIENQYPIDIRENLVIDCEVKQDGFRMHLLSSMLASRMPLLARKKLRFWVKEISVHKPYAILWKVLNRGEESRNRNCIRGQIVNDEGHLEKTEKTNFKGDHVVECYCVKNGVVVAKDRIHVPIATNQEDYE

SEQ ID NO: 5660 - protein, 337 aa, Leptospira interrogans
MSTSDLFSSFIENLAISNMESISSRYGEITAALNKEFRNTDSKIANTLQVGSFGRKTGINGISDLDILYFMPKGKWDTYKDSKQLSLLQDVKSAILKRYPKTEVRVDRLVVTITYTDFHIEVQPVFEQDDGSFKYPDTKDGGNWKITKPREEMEAVSKLDADKNSNLKRLCKMARAWKNKHGVEMGGLLIDTFAYNFLSSTDNYDTKSFNSYGELNRDFFQFLSEQPEQDYYRAPGSNQNVRVKKQFQKKAKKAYDLCVKAIEAKDESGVNDKWKKVFGRPFPSNIESTSDSVQKTASTLWTNTEQFIEDQYPIDIRYDMSIDCNVNQDGFRESTLR

SEQ ID NO: 5661 - protein, 433 aa, Leptospira santarosai
MSTSDLFSSFIENLAISNMESISSRYGEITAALNKEFRNTDSKFANTLQVGSFGRKTGINGISDLDILYFMPKGKWDTYKDSKQLNLLQDVKSAILKRYPKTEVRVDRLVVTIIYTDFHIEVQPVFEQDDGSFKYPDTKDGGNWKITKPREEMEAVSKLDADKNSNLKRLCKMARAWKNKHGVEMGGLLIDTLAYNFLSSTDNYDTKSFNSYGELNRDFFQFLLEQPEQDYYRAPGSNQNVRVKKQFQKKAKKAYDLCVKAIEAKDEAGVNDKWKKVFGRPFPSNIESTSDSIQKTDSTLWTNTEQFIEDQYPIDIRYDMSIDCNVNQDGFRESTLRQMIDKKYPLLPKKTLEFRITFINVPGSYEIYWKILNRGEEAQKRNQVRGQIIKDSGSCEKVEQTLFKGDHVVECYAIKNGILVAKDRIHVPISLNG

SEQ ID NO: 5662 - protein, 433 aa, Leptospira kirschneri
MSTSDLFSSFIENLAISNMESISSRYGEITAALNKEFRNTDSKIANTLQVGSFGRKTGINGISDLDILYFMPKGKWDTYKDSKQLSLLQDVKAAILKRYPKTEVRVDRLVVTITYTDFHIEVQPVFEQDDGSFKYPDTKDGGNWKITKPREEMEAVSKLDADKNSNLKRLCKMARAWKNKHGVEMGGLLIDTLAYNFLNSTDNYDTKSFNSYGELNRDFFQFLSEQPEQDYYRAPGSNQNVKVKKQFQKKAKKAYDLCVKAIEAKDEAGVNDKWKKVFGRPFPSNIESTSDSVQKTAPTLWTNTEQFIEDQYPIDIRYDMSIDCSVNQDGFRENTLRQMIEKKYPLQPKKTLEFRITSINVPGSYEIYWKVLNRGEEAQKRNQIRGQIIKDSGNYEKVEQTLFKGDHVVECYAIKNGILVAKDRIHVPISLNG

SEQ ID NO: 5663 - protein, 433 aa, Leptospira alexanderi
MSISDLFSSFIENLAISNMESISSRYGEITAALNKEFRNTDSKTANTLQVGSFGRKTGINGISDLDILYFMPKGKWDAYKDSKQLSLLQDVKSAILKRYPKTEVRVDRLVVTITYTDFHIEVQPVFEQDDGSFKYPDTKDGGNWKITKPKEEMEAVSKLDADKNSNLKRLCKMARAWKNKHGVEMGGLLIDTLAYNFLTSTDNYDTKSFNSYGELNRDFFQFLSEQPEQDYYRAPGSNQNVKVKKQFQKKAKKAYDLCVKAIEAKDEAGTNDKWKKVFGRPFPSNIESISDSVQKTAPTLWTNTEQFIEDQYPIDIRYDMSIDCNVNQDGFRENTLRQMIEKKYPLQPKKTLEFRITSINVPGSYEIYWKVLNRGEEARKRNQIRGQIIKDSGNYEKVEQTLFKGDHVVECYAIKNGILVAKDRIHVPISLNG

SEQ ID NO: 5664 - protein, 433 aa, Leptospira borgpetersenii
MSISDLFSSFIENLTIRNTESISMRYGEITAALNKEFRDTESKTANTLQVGSFGRKTGINGISDLDILYFMPKAKWDVYKESKQLNLLQDVKSTILKRYPNTEVRVDRLVVTITYTDFHIEVQPVFEQDDSSFKYPDTKDGGSWKITKPREEMEAVSKLDANKNSNLKRLCKMARAWKNKHGIEIGGLLIDTLAYNFLNSTYEYDSKSFSSYGELNRDFFQFLSEQPEQDYYRAPGSNQNVRVKKQFQKKAKKAYDLCVKAIEAKDEVGVNDKWKKVFGRPFPSNIESTSDSVQKTASTLWTNTEQFIEDQYPIDIRYDMIIDCNVNQDGFRESTLRQMIEKKYPLLPRKTLEFRITSINVPGSYEIYWKVLNRGEEAQKRNQIRGQIIKDFGSCEKVEQTLFKGDHVVECYAIKNGILVAKDRIHVPISLNG

SEQ ID NO: 5665 - protein, 438 aa, Unknown
  Description of Unknown: Enterobacteriaceae sequence
MSISDMFSAFLDNLAITNAETISLRYGEITASLNKKFRETESKTANTLQVGSFGRKTGIKGISDLDMLYIMPSSKWDSYKDHGQLNLLKDVKSAILQRYPSTKVKVDRLVVTVTYTDFHVEVQPVFEDSDNDCFLFPDTNGGGVWKTTKPRQEMEAIVEMHNKKNHNLRRLCKMVRAWRNKHGVAMGGLLVDTLSYNFLNSNNDYDEKSFLYYDWMSRDFFKYISELAEQDDYLAPGSRQRVKVKKKFQRKAKKAYELCLEAIEAGDQDNAHSKWKKIFGRPFPAAAVSVENLDYASTSLTWKNTEEFIEDKYPIDITEILEIDCEVKQNGFRQYYLRDMLSKHIPLLNKKDLRFEISKISVAQPYEIFWKVLNRGDVARKKNCVRGQIIKDNGMMQKIESTNFRGDHIVECYCVKDGVVVAKSRIHVPIVLEGKQDD

SEQ ID NO: 5666 - protein, 431 aa, Verrucomicrobium spinosum
MKVAETFNEFLDNLTIQNAETISLRYGELTAALNKKFRETESKTANSLQVGSFGRKTGINGLSDLDMLYIMPQGKWAAYEDGGQLRLLQHTKDAIKARYPSTVVKVDRLVVTVTYTNFHVEVQPVFEQVDGSFKYPDTKGESSWKITKPREEMAEISAKDTDKNNNLKRLCKMARAWRNKHGLEMGGLLVDTLAYNFLCQTTEYDSRSFLYYDWLSRDFFHYLWKLPEQDRYAAPGSRQWVRVKKKFQRKARKAYALSVEAINAEKQKNANEKWRKVYGRPFPLPKEAMEESITKAASTWRDTEEFIEDKYPVDIRYTLKLDCEVKQSGYRINLLRDMLAKKIPLLASKSLEFWVNKITVSEPYTIKWKVLNRGEVAKRRDCVRGQIWPDGGRMRKTETTNFKGDHIVECYAIKDGVVVAKDRIHVPIEDR

SEQ ID NO: 5667 - protein, 440 aa, Aggregatibacter aphrophilus
MSISQMFEEFIDNLAISNKQTISDRYAELTKTLNKQFRDSDSETANTLQVGSFGRKTGINGISDLDMLYIMPKSSWDTYNNAQNGQYKLLSDTKEAVLNRYSRTDVSVDRLVVTVTFSNFYIEVQPVFEQEDGSFKYPDTKNGGSWKITKPREEIDEISSADKDKNQNLRCLCKMARAWKNKHGVAMGGLLIDTLAYNFLKSTDYYDDKSFSYYDWLSRDFFKYLSELPEQTEYAALGSKQRVKVKKKFQKKAKKAYDLCLKAIDAENQSSVNDKWKKIYGRPFPAKKTEMAMESLSASYSQYWQNTEEFIEDKFPIDIREYLKIDCEVKQNGFRKFFLREILKRRIPLKSRKDLLFEIKEISVHKPYEIYWKVLNRGEEAKKRNCIRGQIVPDRGYECKKEETDFYGDHIVECYCIKNGVVVAKGRIHVPIVTDGSDYD

SEQ ID NO: 5668 - protein, 433 aa, Neisseria sp.
MSISQMFEEFIDNLAISNKQTISDRYAELTKTLNKQFRNTDSETANTLQVGSFGRKTGINGISDLDMLYIMPKSTWDTYKNAQYKLLSDTKEAILNRYSRTAVSVDRLVVTVTFSNFYIEVQPVFEQEDGSFKYPDTKDGGSWKITKPREEIDEISSADKDKNQNLRRLCKMARAWKNKHGVAMGGLLIDTLVYNFLKSTDYYDDKSFSYYDLLSRDFFQYLSKLPEQTEYAVLGSKQRVKVKKKFQQEAKKALKVIDAENQSSVNDKWKKIYGRPFPAKKTEMAMESLSASYSQNWQNTEEFIEDKFPIDIREYLKIDCEVKQNGFRKFFLREILKRRIPLKSRKDLLFEIKEISVHKPYEIYWKVLNRGEEAKKRNCIRGQIVPDRGYECKKEATDFYGDHIVECYCIKNGVVVAKDRIHVPIVTDGSDYD

SEQ ID NO: 5669 - protein, 438 aa, Haemophilus influenzae
MSISQMFEEFIDNLAISNKQTISDRYAELTKTLNKKFRDSDSETANTLQVGSFGRKTGIDGISDLDMLYIMPKSSWDTYNNAQNGQYKLLSDTKEAILNRYSRTDVSVDRLVVTVTFSNFYIEVQPVFEQEDGSFKYPDTKNGGSWKITKPREEIDEVSSADKDKNQNLRRLCKMARAWKNKHGVAMGGLLIDTLAYNFLKSTDYYDDKSFSYYDWLSRDFFQYLSELPEQTEYAALGSKQRVKVKKKFQKEAKKAYDLCLKAIDAENQSSVNDKWKKIYGRPFPAKKEPAMESLAATISKQWRNTEQFIEDRFPVDIRENLEIDCEVKQGGSFKFLLRHIPAFMQLKANKELLFKITNISVSQPYEIYWKVLNRGIEAQRRNCIRGQIEKDKGLQQKFEHTDFKGDHIVECYCVKNGVVVAKDRIHVPIVTDGSDYD

SEQ ID NO: 5670 - protein, 439 aa, Moraxella bovoculi
MSIAIMFEEFIENLAISNKETISNRYAEITKVLNKHFRNSDSETANSLQVGSFGRKTGINGISDLDMLYIMPKCKWDTYNNAQNGQYKLLADTKEAILKHYSRTDVSVDRLVVSVAFSNFYIEVQPVFEQEDGSFKYPDTKDGGSWKITKPKEEIRKISSVDEAKNRNLRRLCKMARAWKNKHGVAMGGLLIDTLAYNFLNSTEYYDDKSYLDYDWLSRDFFEYLSKLPEQDYYLALGSNQRVNVKKKFQNKAKKAHKLCLDAIEAENQNNVNDKWKKVYGRPFPAAEKVVVESLLASYEPSYQNTEEFIEDKFPIDIREYLKIDCEVKQNGFRKFFLRDILRSKIPLKSQKDLLFQIKEISVKQPYQIYWKVLNRGDEAKRRDCIRGQITPDAGNNYKKEATNFLGDHIVECYCVKNGVVVAKDRIHVPIVADGSDYD

SEQ ID NO: 5671 - protein, 438 aa, Gallibacterium genomosp. 3
MSTATIFEKFLDNLKISNDEDISNRYAEITTALNKQFRSTDSGTANTLQVGSFGRKTGINGISDLDMLYIMPQASWNTYNTQNGQYKLLLDTKTAILKRYPRTDISVDRLVVSVKFTNFYIEVQPVFEQDDGSFKYPDTKNGGSWKITKPREEIKEISDTDNAKNKNLRRLCKMVRAWKNKHGVAMGGLLIDTLAYNFIKSTTEYDNKSYLYYDRLSRDFFKYLSELPEQAEYAALGSKQRVKVKKKFQKKAGKAYQLCLKAIESEEQANVNTKWKKVYGRPFPASEKLEMALESLDSNYHFENTEEFIENKFPIDIRESLRIDCEVRQNGFRKYLLRDILRRRIPLKSRKDLLFKIEEITVREPYQIYWKVLNRGDEAKKRNCIRGQIVQDDGNKCKKEATKFYGDHIVECYCVKNGVVIAKDRIHVPITTDESDYD

SEQ ID NO: 5672 - protein, 431 aa, Moraxella catarrhalis
MSIAKDFEKFIENLAISNKDTISSHYGEITKTLNKNFRNTDSETDNCLQVGSFGRKTAINGISDLDMLYIMPKSLWGKYNDAQNGQYKLLSDVKEAILTRYPRTQVSVGGLVVCVTFSNYYIEVQPVFEQDDGSFKYPDTSNGGSWKITKPRDEIKEISKADSEKNKNLRRLCKMVRAWKNKHGVAMGGLLIDTLAYNFLNSTTDYDNKSYPYYDCMSRDFFKFLSELPEQTEYAALGSRQRVKVKKKFQKKAKKAYDLCVEAINANNSNEKWKKVYGRPFPAQEKLSNESHTLKNYRDTEEFIEDKFPVDIRENLRIDCEIYQRGWRKHLLRDILRLRRPLKLRKELNFYIKEISVSGSYDIYWKVLNRGTEAERRDCIRGQIVTGGDSKRESSDFYGNHIVECYCVKNGVVIARDRIDVPISNDGGDYE

SEQ ID NO: 5673 - protein, 434 aa, Unknown
  Description of Unknown: zeta proteobacterium sequence
MTISEMFKELLANLAIDNTEQISLRYGEITTALNKKFRSSDSKTANTLQVGSYGRKTAIKGISDLDMLYIMPKSEWDTYKDNKQLKLLQDVKAAIDTRYPSTATRVDRQVVVATFTNFEIEVLPVFEQDDGSFKYPDTYDGGSWCITKPRKEIKAISDMDSDKNSNLRRLCKMTRAWKNKHGVAMGGLLIDTLAHNYLKSTDEYNDKSYTYYDWMIRDFFKYLSELPEQAYYLAPGSNQQVKVKKKFQSKAKKAYKLCLKAIEAGEEKSAHNKWKKVFGRPFPAKEEVTTESSASKSEQTWQNTEEFIEDKYPVDIRYALTIDCKVTQDGFREFLLRGWLKNKIPLKANKRLRFSITLNSTPEPFKVKWKVLNRGDVAKKRNCIRGQIFEGAGNQQLRESTDFTGEHIVECYIIKNGVVVAKDRIDVPIQGANL

SEQ ID NO: 5674 - protein, 426 aa, Unknown
  Description of Unknown: Bathymodiolus thermophilus thioautotrophic gill symbiont sequence
MTIKTMFKDFLRNLAIDNVTQISNRYTEITCALNKHFRDNNSKTKNTLQVGSYGRRTAIKGISDLDMLYIMPSDKWDTYKDNGQAKILCDVRAVILARYPNTTIKVDRYVVAVEFTNFIIEICPVFEQNDGSFKYPDTHAGGKWKITKPREEMQAMQGLNDDKNENLYCLCRMIRAWKNKVGINMNGLLIDTLAYDFLKSTGEYDNKSYAHYDCMCRDFFEYLSELPERGYYHAPSSKQQVYVKQKFQKKAKTAYENCLTAIQKEGSNSVYKKWRKVFGNTFPKSQVIESRNYPQTWDNTEEFIEDKYSVDIRYSLNIDCDVSQDGFRLFHLKYMLLNKMSLKAKKKLRFHIQKNTTPQPYSVKWKVLNRGEKAKKLNQIRGEIIDDAGGEKQEEVTSFKGEHIVECYILKKNVVVARSQISVPIE

SEQ ID NO: 5675 - protein, 268 aa, Citrobacter freundii
MQTAEMFRIFLDNLKIPNERMTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAI

SEQ ID NO: 5676 - protein, 432 aa, Klebsiella pneumoniae
MTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAIDAYENGYTKKCHELWREVFGLTFPKAATEMQDSLGLGSDNFVNESYFARTWRNTEEFTDEKFDDVDIRYPLEVNCIVKESGYRERSIRAYLSDIARPWLPPNKTLSFSINQASLDLIPEPYDIYWKVLNRGKEAEERDEIRGQIILGQTTHTEHTKFRGSHKVWCYIVKNHIVIAQATIDIPIE

SEQ ID NO: 5677 - protein, 429 aa, Cronobacter sakazakii
MQHIIKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAIDAYENGYTKKCHELWREVFGLTFPKAATEMQDSLGLGSDNFVNESYFARTWRNTEEFTDEKFDDVDIRYPLEVNCIVKESGYRERSIRAYLSDIARPWLPPNKTLSFSINQASLDLIPEPYDIYWKVLNRGKEAEERDEIRGQIILGQTTHTEHTKFRGSHKVWCYIVKNHIVIAQATIDIPIE

SEQ ID NO: 5678 - protein, 452 aa, Citrobacter freundii
MQTAEMFRIFLDNLKIPNERMTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAIDAYENGYTKKCHELWREVFGLTFPKAATEMQDSLGLGSDNFVNESYFARTWRNTEEFTDEKFDDVDIRYPLEVNCIVKESGYRERSIRAYLSDIARPWLPPNKTLSFSINQASLDLIPEPYDIYWKVLNRGKEAEERDEIRGQIILGQTTHTEHTKFRGSHKVWCYIVKNYIVIAQATIDIPIE

SEQ ID NO: 5679 - protein, 452 aa, Unknown
  Description of Unknown: Enterobacteriaceae sequence
MQTAEMFRIFLDNLKIPNERMTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAIDAYENGYTKKCHELWREVFGLTFPKAATEMQDSLGLGSDNFVNESYFARTWRNTEEFTDEKFDDVDIRYPLEVNCIVKESGYRERSIRAYLSDIARPWLPPNKTLSFSINQASLDLIPEPYDIYWKVLNRGKEAEERDEIRGQIILGQTTHTEHTKFRGSHKVWCYIVKNHIVIAQATIDIPIE

SEQ ID NO: 5680 - protein, 452 aa, Citrobacter freundii
MQTAEMFRIFLDNLKIPNERMTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFFDFLQKEDVHEHYAAIGSGQRVKVYKNFQRQSKRAFKLCTQAIDAYENGYTKKCHELWREVFGLTFPKAATEMQDSLGLGSDNFVNESYFARTWRNTEEFTDEKFDDVDIRYPLEVNCIVKESGYRERSIRAYLSDIARPWLPPNKTLSFSINQASLDLIPEPYDIYWKVLNRGKEAEERDEIRGQIILGQTTHTENTKFRGSHKVWCYIVKNHIVIAQATIDIPIE

SEQ ID NO: 5681 - protein, 226 aa, Klebsiella pneumoniae
MQTAEMFRIFLDNLKIPNERMTAIATHYKNATRRLNIRFRETENGFNNRLKVGSAGRRTAVSKTSDLDMLYIMPSGLWEAYQVGLNPQRRLLRDVKDALKQTFSQQEVKVDRLVVQIVFDSFHIEVQPVFADGDHFKYPDTKADNGNGGWRVTKPRMEITEMRNFRNNKSRNLHNLCRMLRAWKNRNTVDMGGLLIDTLAWRFLKQTDDYDETGMVSYGFMCRDFF

SEQ ID NO: 5682 - protein, 453 aa, Serratia fonticola
MQTAEMFRIFLNNLKISDERIQAIATHYKNATRRLNIEFRGVENGFNNRLKVGSAGRRTAVSKTSDLDMLYIMPARLWGDYQSGINPQRRLLRDVKEALKLSFTQQEIKVDRLVVQIIFDSFHIEVQPVFETDEGHFKYPDTKANDGNGGWRVTKPRMEITEMRNFRNNKSSNLHNLCRMLRAWKNRNTVDMGGLLIDTLAWRFLKQTDDYDNTGIVSYGLMCRDFFDFLHQEDAHEHYAAIGSGQRVKVYRNFQRQAKRAFKLCTKAIEAYENGSTKKCHEHWREVFGLTFPKAVVEMRDSQGLESANFINESYTAQTWRNTEEFTDEKFDDVDIRYPLEVNCIVKENGYRDRSIRAYLSGIARYWLPPNRTLSFSINQASLDLIPEPYDIYWKVLNRGLEAEQRDEVRGQIVLGQVTHTEHTKFRGAHKVWCYIVKNHIVIAQHVIDIPIE

SEQ ID NO: 5683 - protein, 453 aa, Unknown
  Description of Unknown: Serratia sequence
MQTAEMFRIFLNNLKISDERMQAIATHYKNATRRLNIEFRGVANGFNNRLKVGSAGRRTAVSKTSDLDMLYIMPARLWGDYQSGINPQRRLLRDVKEALKLSFTQQEIKVDRLVVQIIFDSFHIEVQPVFETDEGHFKYPDTKANDGNGGWRVTKPRMEITEMRDFRNNKSSNLHNLCRMLRAWKNRNTVDMGGLLIDTLAWRFLKQTDDYDNTGMVSYGLMCRDFFDFLHQEDAHEHYAAIGSGQRVKVYRNFQRQAKRAFELCTKAIEAYENGSTKKCHEHWREVFGLTFPKAVVEMLDSQGLESANFINESYTAKTWRNTEEFTDEKFDDVDIRYPLEVNCIVKENGYRDRSIRAYLSDIARYWLPPNRTLSFSINQASLDLIPEPYDIYWKVLNRGPEAEQRDEVRGQIVLGQVTHTEHTKFRGAHKVWCYIVKNHIVIAQNVIDIPIE

SEQ ID NO: 5684 - protein, 453 aa, Escherichia coli
MQTAEMFRNFLNNLKISDERMQAIATHYKNATRRLNIEFRGVANGFNNRLKVGSAGRRTAVSKTSDLDMLYIMPARLWGDYQSGVNPQRRLLRDVKEALKLSFTQQEIKVDRLVVQIIFDSFHIEVQPVFETDEGHFKYPDTKANDGNGGWRVTKPRMEITEMRNFRNNKSSNLHNLCRMLRAWKNRNTVDMGGLLIDTLAWRFLKQTDDYDNTGMVSYGLMCRDFFDFLHQEDVHEHYAAIGSVQRVKVYRNFQRQAKRAFKLCTKAIEAYENGSTKKCHEHWREVFGLTFPKAVVEMRDSQGLESANFINESYTAQTWRNTEEFTDEKFDDVDIRYPLEVNCIVKENGYRDRAIRAYLSDMARYWLPPNRTLSFSINQASLDIIPEPYDIYWKVLNRGLEAEQRDEVRGQIVLGQVTHTEHTKFRGDHKVWCYIVKNHIVIAQNVIDIPIE

SEQ ID NO: 5685 - protein, 453 aa, Escherichia coli
MQTAEMFRNFLNNLKISDERMQAIATHYKNATRRLNIEFRGVANGFNNRLKVGSAGRRTAVSKTSDLDMLYIMPARLWGDYQSGVNPQRRLLRDVKEALKLSFTQQEIKVDRLVVQIIFDSFHIEVQPVFETDEGHFKYPDTKANDGNGWWRVTKPRMEITEMRNFRNNKSSNLHNLCRMLRAWKNRNTVDMGGLLIDTLAWRFLKQTDDYDNTGMVSYGLMCRDFFDFLHQEDVHEHYAAIGSVQRVKVYRNFQRQAKRAFKLCTKAIEAYENGSTKKCHEHWREVFGLTFPKAVVEMRDSQGLESANFINESYTAQTWRNTEEFTDEKFDDVDIRYPLEVNCIVKENGYRDRAIGAYLSDMARYWLPPNRTLSFSINQASLDIIPEPYDIYWKVLNRGLEAEQRDEVRGQIVLGQVTHTEHTKFRGDHKVWCYIVKNHIVIAQNVIDIPIE

SEQ ID NO: 5686 - protein, 453 aa, Escherichia coli
MQTAEMFRSFLNNLKISDDRMQAIATHYKNATRRLNIEFRGVANGFNNRLKVGSAGRRTAVSKTSDLDMLYIMPARLWGDYQSGVNPQRRLLRDVKEALKLSFTQQEIKVDRLVVQIIFDSFHIEVQPVFETDEGHFKYPDTKANDGNGGWRVTKPRMEITEMRNFRNNKSSNLHNLCRMLRAWKNRNTVDMGGLLIDTLAWRFLKQTDDYDNTGMVSYGLMCRDFFDFLHQEDVHEHYAAIGSVQRVKVYRNFQRQAKRAFKLCTKAIEAYENGSTKKCHEHWREVFGLTFPKAVVEMRDSQGLESANFINESYTAQTWRNTEEFTDEKFDDVDIRYPLEVNCIVKENGYRDRAIRAYLSDMARYWLPPNRTLSFSINQASLDIIPEPYDIYWKVLNRGLEAEQRDEVRGQIVLGQVTHTEHTKFRGDHKVWCYIVKNHIVIAQNVIDIPIE

SEQ ID NO: 5687 - protein, 453 aa, Pantoea agglomerans
MQTAEMFRTFLNNLKIPDERMQAIATHYKNATRRLNIKFRGSTNGFSNRLKVGSAGRRTAVSKTSDLDMLYIMPAGMWGDYQSGINPQRRLLRDVKDALKQSFTQQEVKVDRLVVQIVFDSFHIEIQPVFETNNGHFKYPDTKANDGNGGWRVTKPRMEITEMRNFRNNKSRNLHNLCRMLRAWKNRNTIDMGGLLIDTLAWRFLKQTDAYDDTGMVSYGLMCRDFFDFLHQEDAHEHYSAIGSGQRVKVYRNFQRQAKRAFELCTQAIEAYDNGSSKKCHDSWRKVFGLTFPKAAIEMRDSQGLESANFINESFTTQTWRNTEEFTDEKFDDVDIRYPLEINCIVKENGYRERSIRAYLSDIARSWLPPNRTLSFLIKQESLDLIPEPYDIYWKVLNRGREAELRDDIRGQIVLGQVTHTEHTKFRGTHKVWCYIVKNRIVIAQSVIDIPIE

SEQ ID NO: 5688 - protein, 435 aa, Desulfovibrio alaskensis
MTIAEMFRSFCDNIRIPSGDVSSISSKYGEITYSLNKKFRDTTSKIANTLQVGSYGRKTGIKGISDLDMLYIMPSVTWNTYKDDQSKLLRDTKEAIVSRYPKTTVKVDRLVVQVLYDTFTVEVQPVFEQEDGSFKYPDTYGGGSWKITKPRKEIEAVRKIDSEKNNNFRMLSRMVRAWKNRNGVVMGGLLIDTLVYKFLMNTDDYDAASYSSYGRLSRDFFEYLKDQPDQNFYFALGSNQQVKVKKKFQTKANQAYNACLRAIKAGETATAHSEWKKVYGRFFPAYVANVRVADEALRYEYTEEFIEDKYPVDIRYSLELECKVTQNGFRVDYLTNLLRRGFHLPPRKTLDFTIDTLDLPDPDMILWKVLNRGAEAERRNCIRGQIVSDKGWRTKQEKTTFKGEHLVECYAVKGGVVVARGRIDVPIERNAENDE

SEQ ID NO: 5689 - protein, 122 aa, Alcanivorax sp.
MTVTEMFSSFLDNLKIENADKISNQYEEITSCLNKKFRDTESRTANSLQVGSYGRYTGIKGISDLDMLYIMPKSEWDTYKDGKQAKLLSDVRAAIQNRYPTSNVKVDSPVVRIEFTNFHVEV

SEQ ID NO: 5690 - protein, 430 aa, Bacteroides fragilis
MTKTEAFDKFLNNIKVDNPDIFCGRYKEITKKLNKTFRDTDSETANCLQVGSYGRYTGIKGISDLDMLYIMPKSTWDTYKDTPSELLRKTRDALLDRYPQTTIKVDRLVVDVFFGNFTFEVQPVYEERDGEEINYKYPDTKTCTYKITKPRQEQNEMINFKQNHGEAHRHLCKMLRAWKNNVGVGMGGLLIDTLTHRFLSNHSEYDNANKSQYGEMCRDFFEYLKDEPKHTHYQALGSDQDVKVKHPFRSKAKIAYKKANEAIKENDESKRHDIWREIFGRQFPKSVSSVVENKMFSSDNPSDHEEFIEDKYPIDVKYDLKLDCIIMRDGFREHLLSELLLKGQRISRVRSLDFTIKTDAPLPYEVKWKARNVGTEAIKRNCLRGEIIDSNRKNNVRHESADFFGPHYMEAYIIKNGIVVARDRIEVPIQ

SEQ ID NO: 5691 - protein, 431 aa, Bacteroides dorei
MTTSTSFSTFLNNIKVDKSNNINSRYKEITKKLNRTFRDTDSETANSLQVGSYGRYTGIKGISDLDMLYIMPKCKWNDYKNKPSTLLADVRDAIQERYPTTSVCYDRLVIDVKFSDFIFEIQPVFEENDEDGNICYKYPDTKYGCYKITKPKHEQQAMADFKREHGEHHRYLCKMVRAWKNHVGVGMGGLLIDTLTYNFLSNRSDLDFSTYSDFNTMSRDFFEYLKNQPKQEHYQALGSHQDVKVKHPFRTKAMETYEICKKAIDENDETKKNDYWREVFGHEFPKHTEGNKTQCFSTTCVDNEQFIEDYYPVDILEEVTLECTIEREGFRTKLLSEVLQRHEFIPKNYKLFFKIKSTTVTGSYNVKWKVRNVGEEAIRRNCLRGQIEDSNKGSHQRKEESNFYGPHFVECYIIKNGIVIARAKINVPIEH

SEQ ID NO: 5692 - protein, 433 aa, Chitinophagaceae bacterium
MNTSQTFEKFLSCIKIKDEKADDISYRYGRITMALNQKFRDTDSKTANSLQVGSYGRYTGINGISDLDMLYIMPASKWEVYNKSGGQSKLLEDTKSAISNTYHSSDIKVDRCVVTVNFSDSHIDVQPVFEIEEQDYHYPDTYNDGSWKITKPRKEMKAMLEFEDNKNRNLRRLCKMARSWKNKHGVYMGGLLIDTLAYNFLKSTTLYDEKSFASYDEMCRDFFKFLSEQSKDQTEYGALGSKQRVKVRKPFIRKAKKAFDLAIEAIAAESYKTKHNKWRDIFGNNFPKYESEEKEAHAINENYTNTEEFIENYYPVDIKYDLKIDCEVKQNGFREGSLREYLFKKIKLMPNKSLRFYIERNDVPIPYTVKWKVTNRGEQALKRDCIRGQIINDFGDLERRENTNFKGSHYVECYIIKNDVVVASDTIDVPISE

SEQ ID NO: 5693 - protein, 433 aa, Mariniradius saccharolyticus
MNTSEIFKEFLNNIKIAEESAESISYRYGRITRAMNQKFRDTDSKTANSLQVGSYGRYTGINGISDLDMLFIMPASKWEEYNKAGGQSKLLHDAKDAISDTYSSSDIKVDRCVVTVNFTDSHIDVQPVFEVEDQDYKYPDTYGSGSWKITKPRKEMDAMVEFEVNKNRNLRRLCKMARSWKNKHGVYMGGLLIDTLAYNFLKSTNYYDSKSFAYYDEMCRDFFKYLYDQPTEQKEYGALGSKQRVKVRKSFNRKAKKAYDLAVEAIDASTDKLKHDKWRDIFGKEFPKYEGEEKEARAINENYRNTEEFIESYHPVDIRYDLKIDCEVKQSGFREGSLRDYLLKKIKLRPNKSLRFFIERIDVPPPHEVKWKVTNRGEQAIKRDCVRGQILSDAGSGERKENTNFKGSHFVECYIVKNNVVVAKDLIDVPISE

SEQ ID NO: 5694 - protein, 432 aa, Elizabethkingia anophelis
MNTSETFKDFLSNIKISDDKADTISYRYGRITKALNEKFRNTESKTANTLQVGSYGRYTGIKGISDLDMLYIMPALKWVDYNKSGGQSKLLQDTKDAISKTYSSSDIKIDRCVVTVNFADSHIDVQPVFEVEDQDYKYPDTYGDGCWKITKPRKEMDAMVEFSDNKNRNLRRLCKMARSWKNKHGVCMGGLLIDTLAYNFLKSTTYYNEKSFAYYDEMCRDFFKYLYDQPKDQTEYGALGSKQRVKVKKSFRRKAKKAYELAEEAIDATSDKTKHNKWRDVFGNDFPKYVNEEKEAVSLNSSYRNTEEFIESKYPVDIRYDLKIDCEVKQNGYRDGLLREFLLKKIKLMPNKSLRFYIEKIDVPAPYVIKWKVTNRGEQAIKRDCIRGQIIDLNSSEKTEMTSFKGSHFVECYIVKDNIVVARDLIDVPISE

SEQ ID NO: 5695 - protein, 432 aa, Unknown
  Description of Unknown: Bacteroidetes sequence
MNTSETFKEFLSNIKISDDKADTISYRYGRITKSLNTEFRNTDSKTANSLQVGSYGRYTGINGISDLDMLYIMPASKWADYNKSGGQSKLLQDTKTAISNTYSSSDIKVDRCVVTVNFTDSHIDVQPVFELDDQDYKYPDTYADGTWKITKPRKEMDAMVEFVANKNRNLRRLCKMARSWKNKHGVCMGGLLIDTLAYNFLKSTTCYDEKSFAYYDEMCRDFFKHLYDQPKDQNEYGALGSKQRVKVKKSFKRKAKKAYDLAEEAIDAASDKTKHNKWRDIFGNDFPKYVNEEKEAASLNSSYRNTEEFIESKYPIDIRYDLKIDCEVKQNGYRDGLLREFLLKKIRLMPNKSLRFYIERIDVPAPYVIKWKVTNRGEQAVKRNCIRGQIIDLNSSEKTETTSFKGSHFVECYIIKDNIVVARDLIDVPISE

SEQ ID NO: 5696 - protein, 434 aa, Flavobacterium beibuense
MNTSDTFKEFVSNIKIPENQADTISYRYGRITKALNEKHRGTDSKTANSLQVGSYGRYTGIKGISDLDMLYIMPNSKWPEYNVSGGQSKLLNDTKSAISNTYSASDIKVDRCVVTVNFLDSHIDVQPVFELEDQDYKYPDTYNSGSWKITKPRKEMSAMREAEDQKNKNLRRLCKMARAWKNKNGVCMGGLLIDTLAYNFLHSTTDYDSSSFSFYDLMCRDFFKFLYDQPKDQKEYGALGSKQRVKVRKSFRRKSKKAYDLAVEAIDSVSDKKKHRKWRDIFGNNFPKYQNEESEACYINESYRNTEEFIESYYPINIRYDLKIDCEIKQNGFRNGLLREFLVKRIKLLPNKSLRFYINQMDVPRPYFVKWKVTNRGEQAIKRDCIRGQIIDDAGSLERKESTNFKGSHFVECYIIKDNMVVAMDSIDVPISEE

SEQ ID NO: 5697 - protein, 433 aa, Chryseobacterium sp.
MNTSLTFQEFLTNIKIKEATANTISYRYGRITKSLNEYFRETSSTTANSLQVGSYGRYSGIKGISDLDMLYIIPSSKWDGYNKSGQLKLLQDTKKAIESTYAASDIKVDRCVVTVKFSDGTHIDVQPVFEIEDQDYRYPDTYGDGSWKTTKPRKEMDAMVEAEPNKNKNLRRLCKMARSWKNKHGVCMGGLLIDTLAYNFLNSTNYFDSKSYFYFDEMSRDFFKYLYDQPKDQKEYGALGSKQRVRVKKSFRRKSKKAYDLACDAIEATSEQTQHNKWRDIYGNDFPKYQNEDNEAKAINLNYQNTEEFIENLYPVVIQYSLEIDCEVKQNGYRDGLLREFLAKRFNLLPGKSLTFFISEINIPYPYTVKWKVTNRGNEAIKKNCIRGQIIDDGGYQQRIESSSFKGGHFVECYIIKDNVVVAKDSIDVPISG

SEQ ID NO: 5698 - protein, 434 aa, Chryseobacterium camelliae
MNVSLTFQEFLGNIKISDEKASTISNRYGRITKALNKYFRTTESTIANSLQVGSYGRYSGIKGISDLDMLYVIPASKWDNYNQKGGQLKLLQDTKTAISNTYSASDIKVDRCVVTVKFSDGTHIDVQPTFEMEDQDYKYPDTYGDGSWKITKPRKEMDAMLEASDNINKNLRRLCKMARSWKNKNGVCMGGLLIDTLAYNFLNSTTYFDTKSYYYYDEMSRDFFKYLYEQPKDQTIYGALGSKQHVKVKKSFKKKANKAYNLANEAIGSTSDQTKHNKWRDVYGSAFPKYENEENEAKAINLHYENTEEFIDDLHFVEIKYNLEIDCEVKQNGYREGLLREYLRKRYPLIAGKSLRFFISEIDVPHPYIVKWKVTNRGNEAIKKNCIRGQITTDGGYEQRIESSSFKGGHFVECYIIKDNIVVAKDSIDVPISG

SEQ ID NO: 5699 - protein, 434 aa, Flavobacterium araucananum
MNTSETFQEFLGNIKISDDKATTISSRYARITKALNQYFRDTESTTANSLQVGSYGRYSGIKGISDLDMLYIMPNSKWNDYNKSGGQTKLLQDTKKAIEKTYSASDIKVDRCVVTVSFSDGSHIDVQPVFEVEDQDYKYPDTYGDGSWKITKPRKEMDAMLEAEPNKNRNLRRLCKMTRSWKNKHGVCMGGLLIDTLAYNFLNSTTNYNTKSFAYFDEMSRDFFKYLYDQPKDQKEYGALGSKQRVKVRKSFRRKSKKAYDLACKAIDAVSDKTKHNKWRDIYGNDFPKYQNEETEARALNLSYKSNEEYIENLYPIEIRYNLEIDCEVKQNGFREGLLREYLRKKYPLIIGRSLRFFISEINIPHPYTVKWKVTNRGNEAIKRNCIRGQITNDFGSEQIVETTNFNGEHYVECYIIKNNIVVAKDSIDVPISA

SEQ ID NO: 5700 - protein, 434 aa, Elizabethkingia anophelis
MKTSETFQEFLSNIKIPEDKADTISYRYGRITKSLNEYFRDTDSKTSNSLQVGSYGRYSGIKGISDLDMLYILPSSKWDTYNKKGGQSQLLKDTKSAISTTYKESDIKVDRCVVTVKFSDGTHIDVQPVFEIEDKDYKYPDTYNEGSWKVTKPRKEMDAMVEFESNKNKNLRRLCKMARSWKNQEGVVMGGLLIDTLAYNFLNSTSDYDDRSYYYYDEMSRDFFKYLYDQPKDQKEYGALGSKQRVKVRKSFRRKAKKAYDLACKAIAATSEKTQHNRWRDIYGKDFPKYKNEENEAKAINMSYHNTEEFIEDLYPINILYDLEIECDIKQDGFREGSLRYYLSHKFPLLSGKKLHFYITSNSVPFPYEVKWKVTNRGEEAIKKDCIRGQIVADSGNEIRVESTNFRGEHFVECYIIKDGIVVAKDSIDVPISR

SEQ ID NO: 5701 - protein, 435 aa, Chryseobacterium palustre
MNTSEKFQEFLSNIKIPDDKATTISGRYERITKRLNEEFRNTDSKTANSLQVGSYGRWSGIKGISDLDMLYIMPVSKWSTYNKKGGQSQLLKDTKEALIKTYPASDVKVDRCVVTVNFSDNSHIDVQPVFEEENQDYTYPDTYGDGSWKTTKPRKEMDAMVESTDTVNKNLRRLSKMARSWKSKHGVVLKGLLLDTLAYNFLKSTEYYDDKSYWYYDEMSRDFFKFLYDQPKDQAEYAALGSRQRVKVLKSFKKKAKKAYDLACEAIAAETEKKEHGKWRDIYGKDFPAYVEEINEAKAINLHFDNTEEFIENSYVVDIRYDLEIDCEVKQNGFREGLLKEYLRKKYPLVIGRSLRFFISSNTVPYPYEVKWKVTNRGTEAIKKNAIRGQIVSDGGNESRVETTSFKGGHFVECYIIKDNLVVARDVIDVPILES

SEQ ID NO: 5702 - protein, 432 aa, Vibrio cholerae
MSVADIFKDFLNNLKVDNAEQVSLRYGEITKSLNQKFRDSESTTANTLQVGSYGRYTGIKGISDLDMLYIMPKSKWDTYKNGKQSQLLTDVKDAIKARYPKTDVRVDRLVVTVTYQNFHVEVQPVFEETDDDGESYFQYPDTYNGGSWKVTKPRQEMKAVKDLNDQKNKNLRLLCKMVRAWRNKHGVAMGGLLIDTLAFNFLKSTSEYDDKGYIYFDWLSRDFFKYLSELPDQDHYKAPGSNQNVKVKKKFQKKAKEAYELCLNAIKAEGSSNQNDKWKKVYGRPFPSAKAVEESVEKASASWRNTEEFIEDQYPVDIRYNISLDCDVSQNGFRENSLGFMLMKKIPLLANKKLLFRVTECDVPGVFTLKWKVLNRGTVAQRKDQIRGQIVNDDGYRTKNESTTFQGEHFVECYAIQDGIVVARASIDVPIQ

SEQ ID NO: 5703 - protein, 432 aa, Vibrio cholerae; identical to SEQ ID NO: 5702

SEQ ID NO: 5704 - protein, 432 aa, Thalassolituus oleivorans
MSVADIFKEFLNNLKVDNAEQVSLRYGEITKSLNQKFRDSESTTANTLQVGSYGRYTGIKGISDLDMLYIMPKSKWDTYKNGKQSQLLTDVKDAIKARYPKTDVRVDRLVVTVTYQNFHVEVQPVFEETGEDGESYFQYPDTYNGGSWKVTKPRQEMKAVKDLNDQKNKNLRLLCKMARAWRNKHGVVMGGLLIDTLAFNFLKSTSEYDDKGYIYFDWMSRDFFKYLSELPDQDHYKAPGSNQNVKVKKKFQKKAKEAYELCLNAIKAEESSNQNDKWKKVYGRPFPSVKAVEESVEKASASWRNTEEFIEDQYPVDIRYNISLDCDVSQNGFRENSLGHMLMKKIPLLANKKLLFRVTECDVPGGFTLKWKVLNRGTIAQRKDQVRGQIVNDEGYRRKNESTTFQGEHFVECYAIQGGVVVARASIDVPIQ

SEQ ID NO: 5705 - protein, 433 aa, Alteromonas sp.
MSVADIFKEFLNNLKVDNAEQVSLRYGEITKSLNQKFRSSESTTANTLQVGSYGRYTGIKGISDLDMLYIMPKSKWDTYKNGKQSQLLTDVKDAIKVRYPKTDVRVDRLVVTVTYQNFHVEVQPVFEETGDDGESYFQYPDTYNGGSWKVTKPRQEMKAVKDLNEQKNKNLRLLCKMARAWRNKHGVAMGGLLIDTLAFNFLKSTTEYDDKGYVYFDWLSRDFFKYLSELPDQDHYKAPGSNQNVKVKKKFQKKAKDAYELCLAAIKAEGNGNVNAKWKMVYGRHFPASIVVEESVSKALGTWRNTEQFIEDTYSVDIKYNFEIDCSVHQNQGLPKSLRGMLANGFGISNNKKLIFKVKNHDIPGHFFVKWKILNVGAEAERRDCIRGEIDIPNYEGSSRKETADFKGVHLAECYAIQNGVVVARDQIQVPIL

SEQ ID NO: 5706 - protein, 432 aa, Haliea salexigens
MSVSDMFQMFLDNLKVDNAEQISLRYGEITSSLNKKFRDTESKEANTIQVGSYGRYTGIKGISDLDMIYIMPKAQWENYKDGKQSQLLTDVKDAIKVRYPKTDIRVDRLVVTVTYSNFHVEVQPVFEEADEDGNSYFKYPDSYNGGSWKITKPRQEMQAIKELNEAKNRNLRLLCKMARAWKNKHGVVMGGLLIDTLAYNFMNSTVEFDDKSFLYFDWLSRDFFKYMADQPDQDHYKAPGSNQNVKVKKRFQSKASDAYELCLKAIEAEKDDSVNDKWKMVYGRNFPASDAENRSALSEQAWRNTEQFIEDFYPVDVRYSLKIDCAVHQRQGLPRSLLLMLEKGFGISNNRKLIFNIVEHDIEGDFEVRWKILNRGVEAKSRDCIRGQIEHSNNGNNSRKESADFQGNHFVECYALKGGVVVARDSIKVPIL

SEQ ID NO: 5707 - protein, 432 aa, Aeromonas caviae
MSVSEMFKEFLDNIKVQKSDQFKQRYEQITKALNLKFRGTDSTTANSLQVGSYGRYTGIKGISDLDMVYIMPSSKWDDYKDHKQSKLLTDVKEAIKSRYPSTDVKVDGLVVSVKYQSFHVEVQPVFDRYNSDGSGYFEFPHTGNGGSWKKTKPRQEMKAVKELNDEKNKNLRLLCKMARAWKNKSGAAMGGLLIDTLAYNFMKSTTDYDDKSYLYFDWLSRDFFKFLADQDKKDHYQAPGSNQDVKVKKDFRKKAEEAYDLCVEAINAEGTAKANEKWREVYGSNFPKAEAVKEAVAKALATWRDTEEFIEDQYPIDVRYNMRLDCDVSQNGFREHTLYQMLSQRIPLLANKRLLFRVEDIEVPPPFTIKWKVLNRGLEAQKKDQIRGQIVTDEGHMRRNEQTSFKGEHFVECYAIKNDVVVARASIDVPIQ

SEQ ID NO: 5708 - protein, 430 aa, Oleibacter marinus
MSVSDMFKEFLENIKVQKSDQFKQRYEQITKALNLKFRGTDSTTANSLQVGSYGRYTGIKGISDLDMVYIMPSSKWDDYKDHKQSKLLTDVKEAIKSRYPSTDVKVDGLVVSVKYQSFHVEVQPVFDRYNSDGSGYFEFPHTANSGSWKKTKPRQEMKAIKDLNDEKNKNLRLLCKMARSWKNKSGVAMGGLLIDTLAYNFMKSTTEYDSAGYSSFGYLSRDFFEYLAGQDKQDHYQAPGSNQDVNVKKDFRKKAEEAYNLCVDAIEAEGKAKSNKKWREVYGSNFPKAEEKSVEKAAATWRDTEQFIEDLYPIDVRYNMRLDCDVSQAGYRTDSLFQMLLKKTPLRPDKQLQFQVGETEVPGNYTLLWKVLNQGPEAQRRNEIRGQIVTDEGYRKRNERTSFRGEHFVECYAVQNGVVVARASIDVPIQ

SEQ ID NO: 5709 - protein, 432 aa, Lentisphaera araneosa
MTTTEMFKTFLSNMKVDNYDQISLRYGEITSALNKKFRDTESKTDNTLQVGSYGRYTGIKGISDLDMIYIMPSGKWDDYKTDQSKLLTDAKNAIKSRYPTTDVKVDRLVVTVKYKNFHVEVQPAFEQDAEDDKSYFKYPDTYNGGSWKDTKPRHEMDEIKASNDRKNKNLRHLCKMIRAWKNKNGVPMGGLLLDTLAYNYLESTTYYDDKSYTYYDWLVRDFFEYLKNRPKQKYYMAPGSNQQVKVRKQFQKKAKQAYEDSLKAIEAGDGAKAHNKWKEIFGREFPKDDTEVVENFTVHWRNTEEFIEDQYPVDIRYSLKIDCTVTQTGFRPDSLLNMIINGVRLKPNKDLEFKVKSIDDIPEPYTIKWKILNKGTEAQRRDCVRGRILNDKGSMLKKESSDFRGDHEVECYVVHNGYVVARDLILVPIQRG

SEQ ID NO: 5710 - protein, 428 aa, Stanieria sp.
MFRDFISNLAIDNADQISLRYGEITASLNKKFRATESKTANSLQVGSYGRWTAIKGISDLDMLYIMPKSKWDDYKAGKQFKLLTDTKDAIKARYPKTTVYVDRLVVRVLYTNFHVEVQPVFEQDDGSFKYPDTYNGGSWKITKPCEEISAMSEFDTQKNKNLRRLCKMARAWKNKHGVSMGGLLIDTLAYNFLKSTTEYDNKSYLYYDWMSRDFFQYLKDLSTQDYYAALGSCQRVRVKKKFQKKAKKAYELCLKAIEAEGKNSVYDKWKKVYGRPFPEKPETVQDAKDSIAIFAERSWDNTEQFIEDLYPIDIRYNLEIDCDVLQNGFREHSLFYFLQKKLRLQPNKKLIFKVAKYDFPDNSDVYWKVLNRGEVARKRNCIRGQIVRDSGFKSTVEHTNFRGEHIVECYAVQNGVVIAKDRIDVPIE

SEQ ID NO: 5711 - protein, 433 aa, Stanieria sp.
MTTSEMFRDFISNLAIDNADQISLRYGEITASLNKKFRATESKTANSLQVGSYGRWTAIKGISDLDMLYIMPKSKWDDYKAGKQFKLLTDTKDAIKARYPKTTVYVDRLVVRVLYTNFHVEVQPVFEQDDGSFKYPDTYNGGSWKITKPCEEISAMSEFDTQKNKNLRRLCKMARAWKNKHGVSMGGLLIDTLAYNFLKSTTEYDNKSYLYYDWMSRDFFQYLKDLSTQDYYAALGSCQRVRVKKKFQKKAKKAYELCLKAIEAEGKNSVYDKWKKVYGRPFPEKPETVQDAKDSIAIFAERSWDNTEQFIEDLYPIDIRYNLEIDCDVLQNGFREHSLFYFLQKKLRLQPNKKLIFKVAKYDFPDNSDVYWKVLNRGEVARKRNCIRGQIVRDSGFKSTVEHTNFRGEHIVECYAVQNGVVIAKDRIDVPIE

SEQ ID NO: 5712 - protein, 431 aa, Unknown
  Description of Unknown: Methylomonas sequence
MSVSDMFKDFLDNLKIDNSEQISLRYGEITACLNKKFRDTESKTANSLQVGSYGRWTGIKNISDLDMLYIMPASKWNDYKNGGQSKLLTETKDAIKARYPSTTVYVDRLVVRVLYTNFHVEVQPVFEQEDGSFKYPDTYNGSSWKITKPREEIKAMSEFVTQKNKNLRRLCKMARAWKNKHGVGMGGLLIDTLAYNFLKSTNDYDDKSFSSYDFLSRDFFKYLSDQPNQDYYAALGSGQRVKVKQKFQKKAKKAYDLCLKAIEAEKTDGVNDKWKKVYGRPFPARLTETKDSSAKAAQTWENTEQFIEDKYPVDIRYGLKIDCEVSQNGFREHFLTEMLAKRIPLLAKKKLLFTISENNVPEPYSIEWKVLNRGEEAKKRNCIRGQIVSDDGQHKRKESTNFKGDHIVECFVIKDGVVVAKDRIDVPIRWE

SEQ ID NO: 5713 - protein, 429 aa, Unknown
  Description of Unknown: Vibrio sequence
MAITEMFRDFLQNLKIDNSDKISNRYDEITVSLNKKFRDTESKKANSLQVGSYGRWTAIKGISDLDMLYIMPKGKWDYYKDGKQSQLLSDVRDAIKARYPTTDVRVDRLVVTVTYTNFHIEVQPVFEQDDGSFKYPDTYNGGSWKITKPREEIAAMTEFSREKNNNLRNLCRMARAWKNKHGVGMGGLLIDTLAHNFLKSTDYYDDKGFLYYDYMSRDFFEYLSKLPKQDRFAALGSGQHVKVKKQFQRKAKKAYELCLKAIDAGDASHEKWKKVYGRPFPVAATVTKAVAEALESRSTWRNTEQFIEDLFPIDIRYPLSLDCEVSQRGYREHFLTDMLAHKIPLLVNKKLLFTVSDIQVPEPYQLKWKVLNRGAEAQKRDCIRGQVFDDDGYKRRNESTSFKGEHIVECYAIKNGIVVAKDRIHVPIQ

SEQ ID NO: 5714 - protein, 429 aa, Vibrio tritonius
MAITEMFRDFLQNLKIDNSDKISNRYDEITVSLNKKFRDTESKKANSLQVGSYGRWTAIKGISDLDMLYIMPKGKWDYYKDGKQSQLLSDVRDAIKARYPTTDVRVDRLVVTVTYTNFHIEVQPVFEQDDGSFKYPDTYNGGSWKITKPREEIAAMTEFSREKNNNLRNLCRMARAWKNKHGVGMGGLLIDTLAHNFLKSTDYYDDKGFLYYDYMSRDFFEYLSKLPKQDRFAALGSGQHVKVKKQFQRKAKKAHELCLKAIDAGDASHEKWKKVYGRPFPVAATVTKAVAEALESRSTWRNTEQFIEDLFPIDIRYPLSLDCEVSQRGYREHFLTDMLAHKIPLLVNKKLLFTVSDIQVPEPYQLKWKVLNRGAEAQKRDCIRGQIFDDDGYKRRNESTSFKGEHIVECYAIKNGIVVAKDRIHVPIQ

SEQ ID NO: 5715 - protein, 429 aa, Salinivibrio sp.
MAITEMFRDFLQNLKIDNSDKISNRYDEITVSLNKNFRDTESKKANSLRVGSYGRWTAIKGISDLDMLYIMPKGKWDYYKDGKQSQLLSDVRSAIKARYPTTNVRVDRLVVTVTYTNFHIEVQPVFKQDDGSFKYPDTYNGGSWKITKPSEEIAAMTEFSREKNNNLRNLCRMARAWKNKHGVGMGGLLIDTLAHNFLKSTDYYDDKGFLYYDYMSRDFFEYLSKLPKQDRFAALGSGQHVKVKKQFQRKAKKAYELCLKAIDAGDASHEIWKKVYGRPFPVAAKVTKAVADALESRSTWRNTEQFIEDFFPIDIRYPLSLDCEVSQRGYREHFLTDMLARKLPLHINKKLLFTVSNIQVPEPYQLKWKVLNRGAEAQKRDCIRGQIFDDDGYKRRSESTSFKGEHIVECYAIKNGIVVAKDRIHVPIQ

SEQ ID NO: 5716 - protein, 428 aa, Photobacterium damselae
MAITEMFRDFLQNLKVDNSDKISNRYDEITASLNKKFRNTESKKDNSLQVGSYGRWTAIKGISDLDMLYIMPKGKWGYYKDGKQSQLLSDVRSAIKARYPTTDVRVDRLVVTVTYTNFHIEVQPVFEQDDGSFQYPDTYNGGSWKTTKPREEIAAMAEFSKEKNNNLRNLCRMARAWKNKHGVGMGGLLIDTLAHNFLKSTNYYDDKSFLYYDYMSRDFFEYLSKLPKQDRFAALGSGQHVKVKKQFQRKAKKAYELCLKAIEAGDASHDKWKKVYGRPFPAEATTKAVSEAFESHSTWQNTEQFIEDFFPIDIRYPLSLDCEVSQRGYREHFLTDMLARKLPLLVNKKLLFTVSDIQVPEPYQLKWKVLNRGAEAQKKDCIRGQILDDDGYKRRNESTNFKGEHIVECYAIKNGIVVAKDRIHVPIQ

SEQ ID NO: 5717 - protein, 428 aa, Vibrio sp.
MAITEMFRDFLQNLKVDNSDKISNRYDEITASLNKKFRDTESKKANSLQVGSYGRWTAIKGISDLDMLYIMPKGKWGHYEDGKQSQLLSDVRSAIKARYPTTDVRVDRLVVTVTYTNFHIEVQPVFEQDDGSFKYPDTYNGGSWKTTKPREEIAAMTEFSREKNNNLRNLCRIARAWKNKHGVGMGGLLIDTLAHNFLKSTDYYDDKGFLYYDYMSRDFFEYLSKLPKQDRFAALGSGQHVKVKKQFQRKAKKAYKLCLKAIDAGDASHDKWKKVYGCPFPAATATKAVAEAFESRSTWRNTEQFIEDLFPIDIRYPLSLECEVSQRGYREHFLTDMLARKLPLLVNKKLLFTVSDIQVPEPYQLKWKVLNRGAEAQKKDCIRGQILDDDGYKRRNESTSFKGEHIVECYAIKNGIVVAKDRIHVPIQ

SEQ ID NO: 5718 - protein, 428 aa, Vibrio sp.
MAITEMFRDFLQNLKVDNSDKISNRYDEITASLNKKFRDTESKKANSLQVGSYGRWTAIKGISDLDMLYIMPKGKWGHYEDGKQSQLLSDVRSAIKARYPTTDVRVDRLVVTVTYTNFHIEVQPVFEQDDGSFKYPDTYKGGSWKTTKPREEIAAMKEFSSEKNNNLRNLCRIARAWKNKHGVGMGGLLIDTLAHNFLKSTDYYDDKGFLYYDYMSRDFFEYLSKLPKQDRFAALGSGQHVKVKKQFQRKAKKAYKLCLKAIDAGDASHDKWKKVYGRPFPAATATKAVAEAFESRSTWRNTEQFIEDLFPIDIRYPLSLECEVSQRGYREHFLTDMLARKLPLLVNKKLLFTVSDIQVPEPYQLKWKVLNRGAEAQKKDCVRGQILDDDGYKRRNESTSFKGEHIVECYAIKNGIVVAKDRIHVPIQ

SEQ ID NO: 5719 - protein, 429 aa, Photobacterium sanguinicancri
MAITDMFSDFLQNLKVDNAEQISNRYDEITGSLNKKFRDTESKQANSLQVGSYGRWTAIKGISDLDMLYIMPKGKWDDYKNGKQYQLLSDVREAIKARYPKTDVCVDRLVVTVIYTNFHVEVQPVFEQDDGSFKYPDSYNGGSWKITKPREEIAAMTEFSRDKNNNLRNLCRMARAWKNKHGVGMGGLLIDTLAHNFLKSTDYYDDKSFLYYDWMSRDFFKYLSDLPKQDRFAALGSGQHVKVKKQFQRKAEKAYKLCLKAIDAGESSHDKWKKVYGRPFPAAANATKAATEAFESYSTWLNTEQFIEDRYPVDIRYPLALECEVSQNGYRVNILTRMLAQKIPLLANKKLLFTISEIQVPDPYQIKWKVLNRGAEAQRKDCIRGQILDDGGYNRRNESTSFKGEHVVECYAIKNGIVVAKDRIHVPIQ

SEQ ID NO: 5720 - protein, 428 aa, Desulfotalea psychrophila
MTISEMFQDLLANLVTDNAGKISLKYGEITSSLNKKFRETDSKKENRLQVGSYGRWTGVKGISDLDMLYLMPKNKWDDYKNNKQSKLLLDTKDAIKARYPTTEVKVDRLVVQVLYRGFQVEVQPVFEQDDESFKYPDTYSGGSWKITKPRDEMTAMKDFVDQKSKNLRKLCKMARAWKNKHGVGMGGLLIDTLAHNFLKSTSDYDDKSFLFYDWMSRDFFKYLMEQPSQDHYKALGSGQNVKVKKKFQKKAKKAYELCLKAIEAGDGNSAHDKWKKVYGRPFPAKSKHVEEALKSARTWQDTEQFIEEKFPIDVRYDLELECEVTQHGYQKRFLTEMLAKNFPLLANKKLYFNISYINVPKPYSIKWKVLNRGVEAEKRNCICGQIVDDSGKKERRESTDFKGEHIVECYAIKNNVVVAKNRIYVPIK

SEQ ID NO: 5721 - protein, 429 aa, Idiomarina piscisalsi
MAVAEMFSDFLNNLRVDNADTISSRYGEITSSLNKKFRDSESKTNNSLQVGSYGRWTAIKGVSDLDMLYIMPAGQWDKYKSGGQSKLLTDAKDAIKARYPKTDVRVDRLVVTATYQNFHIEVQPVFEQEDGSFKYPDTYNGGRWSITKPREEIRAMKEFVEQKNRNLRRLCKMARAWKNKHGVGIGGLLIDTLAHNFLNSTSDYDGRSYLYYDWMGRDFFKYLSDLPDQSHYKALGSGQNVKVKSKFQRKAKKAYQLCLSAIEAGDSDSANNKWKKVYGRPFPGKTQKVQESAAKSQKAWRDTEQFIEDQYPVDIRYSMTLECEVSQRGFREHYLTHMLAKAIPLLANKKLLFTVKYCSVPEPYLIKWKVLNRGAEAKRKDCIRGQIFSDEGYNKRKESTDFRGEHVVECYAIKNGVVVAKDRIDVPIQ

SEQ ID NO: 5722 - protein, 432 aa, Marinobacter sp.
MSISQLFTGLLDNLRVDNSENISLKYNQITKSLNKKFRDTESETQNSLQVGSYGRYTGIKDISDLDMLYVMPQGKWEDYKDNQYRILSDTKDAIKARYPETDVRVDRLVVTVSYTNFLLEVQPVFERKDNDDIPYYLFPDTKGDGRWRETKPRHEMIAMKEFDQQKNRNLRRLCKMTRAWKDKHGVGMGGLLVDTLAHNFLKQNTAYDNQSYGSYHLLNRDFFEFLAGQPDKNHYKALGSGQNVEVKTKFQKKASEAYDLCIAAIAAAETKSENEKWRKVFGRRFPAYEGIRDDRMSKAVKTWRDSEQFIENFHPVNVQYNIELDCDVSQNGYRESNLWVMLKRGLRLQPQKTLWFTVKSCNVPQPYSVKWKVLNRGAEAEQRDEVRGQIFDDEGRNRRKETTKFAGEHLVEVYAIKDNIVVAKARIYVPIR

SEQ ID NO: 5723 - protein, 425 aa, Psychromonas sp.
MTTSEMFKELFRNLAIDNAATISTKYGEITRSLNQNFRYTESKTNNTLQVGSYGRWTGIKGISDLDMLYIMPNSQWDTYKNDQSKLLTDTKDAIKARYPKTEVKVDRLVVQVIYTNFMVEVQPVFRRRDGGFYYPDTYKGGSWKVTKPQEEIDEVKNFVDNKTSNFRHLCKMARTWKNKHGVGMGGLLIDTLAYNFLNSTTDYDDKSFTDYDWMCRDFFKYLADEPNKNHYAALGSRQQVKVRSKFQRKAKKAYDLCLKAIDAGEADSANKKWKKVFGRPFPAVESVQERKSADAFRQPEQFIEDLYPIDIRFNVKIECEVLQNGFRESLLRTMLARKIKLSASKKLKFYVESINVPDGFIIKWKVLNRGAEAERRNCIRGDIVIDKGFRKKEEKTDFIGEHIVECYVIKNGVVVAKDRIDVPIQ

SEQ ID NO: 5724 - protein, 425 aa, Pseudoalteromonas sp.
MTTSEMFKDFLSNLKVDNASNISLRYGEITNSLNKQFRGTESKTTNTLQVGSYGRWTGIKGISDLDMLYVMPSTKWNDYKNDQSKLLEDTRDAIKARYSNTEVKIDRLVVQIVYTNFMVEAQPVFKQDDGSFKYPDTYNGGSWKITKPKEEIDEVKNVVDNKTNNFRHLCKMARAWKNKHGVGMGGLLIDTLAYNFLNSTTEYDNKTHAYYDLMCRDFFKYLADEPNKEYYAALGSRQQVKVKEKFQSATLDAYDLCLAAIKAGGQDSANNKWKKVFGRNFPAAQTVQKSKSLKAFKNTEQFIEDLHPVDIRYSLKIECEVTQNGFRSDFLTKMLANRTPLLANKRLDFMVEKINVPGEYIIKWKVLNRGTEAEKKDCVRGQIFRDDGFRKRRETTTFKGEHIVECFAIQNGVVVAKDRINVPIQ

SEQ ID NO: 5725 - protein, 426 aa, Vibrio metoecus
MTTTDDVYRFSKKIWRLNNGASITSKYEEITSALNKKFRDTESKTANSLQVGSYGRWTGIKGISDLDMLYIMPASKWDEYKDGKQSKLLDDTRDAIQARYPRTVVKKDRLVVQILYKNFIVEVQPVFEQEDSSFKYPDTYNGGSWKITKPRDEIKAMKEFVDQKNKNLRKLCKMARAWKNKHGVGMGGLLIDTLAYNFLKSTADYDNRSTAFYDWMCRDFFLYLSEEPNKDYYLALGSNQRVKVRNKFQRKAKKAYELSCDAIAAGDDSSAHTKWKKIFGRPFPAAPQAVAQAAKSYRDTEQFIEDYYPLDIRFHLKLECEVSQDGFRVDLLRSMLARKLKLSPKKQLNFYVSEIDVPGDFILKWKVLNRGAEAERRDCIRGDIVVDKGFRKKQEKTDFAGEHVVECYAIKNGVVVAKDRIHVPIQ

SEQ ID NO: 5726 - protein, 424 aa, Alteromonas sp.
MTTSEMFSSFLSNLAIDNGASITSKYEEITSALNKKFRDTESKTANSLQVGSYGRWTGIKGISDLDMLYIMPASRWTDYENSKQSKLLDDTRDAIKARYPSTTVKKDRLVVRVVYNNFMVEVQPVFEQRDGSFKYPDTYNGGSWKITKPRDEIRAMKEFVAQKNKNLRKLCKMARAWKNKHGVGMGGLLIDTLAYNFLKSRTDYDNRSTACYNWMCRDFFLYLSEEPDKDYYLALGSNQRVSVKSKFQRKAKKTYEQCCDAIAAGESSSANKKWKKVFGRPFPAAQTEAKAVKAYRDTEQFIEDLYPLDVRFNLKLECEVSQNGFRVELLRNMLSRRLKLSPSKRLDFYVTEIDVPGEFTMKWKVLNRGAEAERRDCIRGNIVTDEGYRKKRESTSFAGEHIVECYAIQNGVVVAKDRIHVPIQ

SEQ ID NO: 5727 - protein, 426 aa, Providencia stuartii
MITSEMFTDFLKNLAIDNGTSITSKYEEITSALNKKFRDTESKTANSLQVGSYGRWTGIKGISDLDMLYIMPASKWNNYKDGKQSKLLDDTRDAIKARYSNTEVKKDRLVVQVLYKNFTVEVQPVFEQDDGSFKYPDTYNGGSWKITKPLDEIKAMKEFVDQKNKNLRKLCKMARAWKNKHGVGMGGLLIDTLAYNFLKSRTDYDNRSAAFYDWMCRDFFLYLSEEPNKDYYLALGSNQRVNVKSKFQRKAKKTYDLCCDAIAAGENDSANKKWKKVFGRPFPSATKAEARSIAKAFKDTEQFIEDLYPLDIRFNLKIECEVSQDGFRVDLLRTMLSRKLKLSPKKQLNFYVDEIDVPGEFTLKWKVLNRGAEAERRDCIRGDIVIDKGFREKQEKTDFAGEHIVECYAIQNGVVVAKDRIHVPIQ

SEQ ID NO: 5728 - protein, 426 aa, Proteus mirabilis
MTTSEMFTDFLENLAIDNGMSITSKYEEITSALNKKFRDTESKTANSLQVGSYGRWTGIKGISDLDMLYIMPASKWNNYKDGKQSKLLDDTRDAIKARYSNTEVKKDRLVVQVLYKNFTVEVQPVFEQDDGSFKYPDTYNGGSWKITKPRDEIKAMKEFVDQKNKNLRKLCKMARAWKNKHGVGMGGLLIDTLAYNFLKSRTDYDNRSAAFYDRMCRDFFLYLSEEPNKDYYLALGSNQRVNVKSKFQRKAKKTYDLCCDAIAAGENDSANKKWKKVFGRPFPSATKAEARSIAKAFKDTEQFIEDLYPLDIRFNLKIECEVSQDGFRVDLLRTMLSRKLKLSPKKQLNFYIDEIDVPGEFTLKWKVLNRGAEAERRDCIRGDIVIDKGFREKQEKTDFAGEHIVECYAIQNGVVVAKDRVHVPIQ

SEQ ID NO: 5729 - protein, 426 aa, Klebsiella pneumoniae
MTTSEMFTDFLKNLAIDNGTSITSKYEEITSALNKKFRDTESKTANSLQVGSYGRWTGIKGISDLDMLYIMPASKWNSYKDGKQSKLLDDTRDAIKARYSNTEVKKDRLVVQVLYKNFTVEVQPVFEQDDGSFKYPDTYNGGSWKITKPRDEIKAMKEFVDQKNNNLRKLCKMARAWKNKHGVGMGGLLIDTLAYNFLKSRTDYDNRSAAFYDWMCRDFFLYLSEEPNKDYYLALGSNQRVNVKSKFQRKAKKTYDLCCDAIAAGENDSANKKWKKVFGRPFPSATKAEARSIAKAFKDTEQFIEDLYPLDVRFNLKIECEVSQDGFRVDLLRTMLSRKLKLSPKKQLNFYVDEIDVPGEFTLKWKVLNRGAEAERRDCIRGDIVIDKGFRKKQEKTDFAGEHIVECYAIQNGVVVAKDRIHVPIQ

SEQ ID NO: 5730 - protein, 426 aa, Alteromonas sp.
MTTTEMFTDFLANLKIDNAASITSKYEEITSALNKKFRDTESKTANSLQVGSYGRWTGIKGISDLDMLYIMPASKWNDYKDGKQSKLLDDTKDAISARYPRTTVKKDRLVVQVNYNGFMVEVQPVFEQDDGSFKYPDTYNSGSWKITKPREEIKAMKEFVDQKNKNLRKLCKMARAWKNKSGVGMGGLLIDTLAYNFLKSSSDYDNRSTAYYDWMCRDFFKYLSEEPTKDYYLALGSNQRVNVKANFQRKAKIAYEDSLKAIDAGESSSANKKWKKIFGRPFPAAVIQESKSSAYNYRNTEQFIEDSYSVDIRYNLTLECEVSQNGFREVLLRTMLARKLKLQAKKKLKFYVADINVPGDFILKWKVLNRGTEAERRDCIRGDIVIDKGFRNKEEKTDFNGEHIVECYAIQNGVVVARDRIDVPIQ

SEQ ID NO: 5731 - protein, 426 aa, Marinomonas polaris
MTTTEMFTDFLANLKIDNAASITSKYEEITSALNKKFRDTESKTANSLQVGSYGRWTGIKGISDLDMLYIMPASKWNDYKDSKQSKLLDDTKDAISTRYPRTTVKKDRLVVQVIYNGFMVEVQPVFEQDDGSFKYPDTYNSGSWKVTKPREELKAMKEFVDQKNKNLRKLCKMARAWKNKSGAGMGGLLIDTLAYNFLKSSSDYDNRSKVFYDWMCRDFFKYLSEEPTKDYYLALGSNQRVNVKAKFQRKAKIAYENSLKAIEAGESSSAHKKWKKIFGRPFPAAAIQESKSSAYNYRNTEQFIEDSYTVDIRYNLTLECEVSQNGFREALLRTMLASKLKLQAKKKLKFYVADINVPGDFILKWKVLNQGTEAEKRDCIRGDILVDKGFRNKEEKTDFNGEHVVECYAIQHGVVVAKDRIDVPIQ

SEQ ID NO: 5732 - protein, 426 aa, Paraferrimonas haliotis
MTTTEMFTDFLSNLKIDNAASITTKYEELTSALNKNFRNTDSKTANSLQVGSYGRWTGIKGISDLDMLYIMPASKWNDYKDGKQSKLLDDTKAAISARYPKTTVKKDRLVVQVIYSGFMVEVQPVFEQDDGSFKYPDTYNGGSWKITKPRKEIKAMKEFVDNKNNNLRKLCKMARAWKNKCGVGMGGLLIDTLAYNFLKSTSDYDNRSTAFYDWMCRDFFKYLSDEPNKDYYLALGSNQRVNVKAKFQRKAKKAYENSLKAIEAGETSSAHKKWKKIFGRPFPAAVTQETKSSAYNFRNTEQFIEDTYTVDVRYNLTLECEVSQNGFREALLRTMLAQKLKLKAKKKLNFYVSDINVPGEYIVKWKVLNRGTEAERRDCIRGDIVIDKGFRKKEEKTDFYGEHIVECYAIQNGVVVAKDRIDVPIQ

SEQ ID NO: 5733 - protein, 424 aa, Colwellia sp.
MTTTEMFTDFLKNVAIDNSASITSKYEEITAALNKKFRNTESKTANSLQVGSYGRWTGIKGISDLDMLYIMPSSKWNDYKDGEQSKLLDDTKEAIQARYPKTIVKKDRLVVQVLYKSFTVEVQPVFEQDDSSFKYPDTYNGGSWKITKPRDEIKAMKEFVDQKNKNLRKLCKMGRAWKNKCGVGMGGLLIDTLAYNFLNSNSDYDNRSLAYYDWMCRDFFKYLSEEPNKDYYLALGSNQRVTVKSKFQRKAKKAYELSLDAINAGESSSANKKWKKIFGRPFPAAIQQESKSSVYRNTEQFIEDLYPIDIRFNVRLECEVSQNGFREALLRTMLAKKLKLQSKKKLNFFIADIDVPGEFIIKWKVLNRGAIAEQRDCVRGDIIIDKGFRKKEEKTDFNGEHIVECFVIQNDVVVAKDRIDVPIQ

SEQ ID NO: 5734 - protein, 427 aa, Psychrobacter aquaticus
MTTTDMFTGFLENLKVKNSHSITSKYERITSTLNQEFRGLDSKKDNRLRVGSYGRWTGINGISDLDMLYIMPNSKWEEYKDGKQSKLLDDTRDAILTTYPTTKVKKDRLVIQVLFSGFMVEVQPVFEQSDGSYKYPDSYGNGSWKTTKPREEIQAMQEFVEQKNRNLRKLCKMVRAWKNKHGVGIGGLLIDTLAYNFLRSNSNYDNRSVAYYDLMCRDFFKYLSEEPIKDYYLALGSDQRVNVKSKFQKRALKAYKLSLEAIEAGESPTAHKKWKNIFGRAFPASSIQENKSAQTIFDNTEEFIEDFYPVDIRYNLEVDCVISQNGYRVNSLRSMLANNLKLLPKKDLRFSICDINVPDNYTVKWKVLNRGSEAERRNLVRGHIIDSNDGFEVRKETTDFNGEHIVECFAIQNGVVVAKGRIKVPIQ

SEQ ID NO: 5735 - protein, 426 aa, Vibrio cyclitrophicus
MTTSEMFQNFLGNLTIKNGQVISDRYGEITASLNKKFRDTESKTANSLQVGSYGRWTGIRGISDLDMLYIMPAGKWNDYKDGKQSKLLSDTRDAIKARYPKTEVKVDRLVVQVVYKDFMVEVQPVFEQPDRSFKYPDTYNRGSWKITKPKEEIEAMKEFVDQKNRNLRKLCKMGRAWKNKCGVAMGGLLIDTLAYNFLKSSTYYDDKSYTYYDWMCRDFFKYLADEPDKEFYAALGSRQRVAVKKKFQRKAKKAYELALEAIDAASESTRHNKWKSIFGRSFPAAENTHGAKAATAWRDTEQFIDDLYPLDVKYSLVLDCDVSQNGFRENTLRHMLAQRIPLLAKKKLLFTVTECFVPEPFTLKWKVLNQGAEAERRDCIRGQIIEDEGHGKRKETTSFQGGHLVECYAVKNGVVVARDWITVPIQ

SEQ ID NO: 5736 - protein, 421 aa, Vibrio cyclitrophicus
MFQNFLGNLTIKNGQVISDRYGEITASLNKKFRDTESKTANSLQVGSYGRWTGIRGISDLDMLYIMPAGKWNDYKDGKQSKLLSDTRDAIKARYPKTEVKVDRLVVQVVYKDFMVEVQPVFEQPDRSFKYPDTYNRGSWKITKPKEEIEAMKEFVDQKNRNLRKLCKMGRAWKNKCGVAMGGLLIDTLAYNFLKSSTYYDDKSYTYYDWMCRDFFKYLADEPDKEFYAALGSRQRVAVKKKFQRKAKKAYELALEAIDAASESTRHNKWKSIFGRSFPAAENTHGAKAATAWRDTEQFIDDLYPLDVKYSLVLDCDVSQNGFRENTLRHMLAQRIPLLAKKKLLFTVTECFVPEPFTLKWKVLNQGAEAERRDCIRGQIIEDEGHGKRKETTSFQGGHLVECYAVKNGVVVARDWITVPIQ

SEQ ID NO: 5737 - protein, 426 aa, Vibrio cyclitrophicus
MTTSEMFQSFLGNLTINNGQAISDRYGEITASLNKKFRDTESKTANSLQVGSYGRWTGIRGISDLDMLYIMPAGKWNDYKDGKQSKLLSDTRDAIKARYPKTEVKVDRLVVQVVYKDFMIEVQPVFEQADRSFKYPDTYSGGSWKLTKPREEIEAMKEFVDQKNRNLRKLCKIGRAWKNKCGVAMGGLLIDTLAYNFLKSSIDYDDKSYAYYDWMCRDFFKYLADESDREFYAALGSRQRVTVKKKFQRKAKKAYELALEAIDASNENIRHNKWKSIFGRPFPAAEKANVAKAATTWRDTEQFIDDLYSLDVKYSLVLDCDVSQNGFRDNTLRYMLAQRIPLLAKKKLLFTVTECSVPEPFTLKWKVLNQGAEAERRDCIRGQIFEDEGHKQRKESTDFQGSHLVECYAIKNGVVVARDQLAVPIL

SEQ ID NO: 5738 - protein, 426 aa, Vibrio nigripulchritudo
MTTSEVFQSFLGKLTINNGQVIGDRYGEITASLNKKFRDTESKTANSLQVGSYGRWTGIQGISDLDMLYIMPAGKWKDYRDGKQSKLLSDTRDAIKARYPKTEVKVDRLVVQVVYKNFMVEVQPVFEQADRSFKYPDTYSGGSWKITKPREEIEAMKEFVDQKRRNLRKLCKMGRAWKNKCGVAMGGLLIDTLAYNFLKSGTDYDDKSYAYYDLMCRDFFKYLADEPDKEFYAALGSRQRVAVKKKFQCKAKKAYGLALEAIDASSENTRHNKWKSIFGRPFPAAEKTRVAKAGTTWRDTEQLIDDLYSLDVKYSLVLDCDVSQNGFRESTLRHMLARRIPLLAKKKLLFKVTECSVPEPFKLKWKVLNKGEEAERLDCIRGQIFEDEGYRQRKESTDFQGSHLVECYAIKHGVVVARDQIAVPIQ

SEQ ID NO: 5739 - protein, 421 aa, Unknown
  Description of Unknown: Vibrio sequence
MFQSFLGNLTINNGQAISDRYGEITASLNKKFRDTDSKTANSLQVGSYGRWTGIRGISDLDILYIMPAGKWNDYKDGKQSKLLTDTRDAIKARYPKTEVKVDRLVVQVVYTDFMVEVQPVFEQADRSFKYPDTYHGGSWKITKPREEIEAMKEFVDQKNRNLRKLCKMGRAWKNKCGVAMGGLLIDTLAYNFLKSSTDYDDKSYAYYGWMCRDFFKYLVDEPDKEFYAALGSRQRVTVKKKFQRKAKKAYELALEAIDASSESTRHNKWKSIFGRPFPAAEKTCVAKAATTWRGTEQFIDDLYSLDVKYSLVLDCDVSQNGFRESSLRHMLARRIPLLAKKKLLFTVTECSVPEPFTLKWKVLNQGAEAERRDCIRGQIFEDEGYRQRKESTDFQGEHLVECYAIKNGVVVARDQIAVPIQ

SEQ ID NO: 5740 - protein, 221 aa, Acinetobacter pittii
MSVSQMFQDFLSNIKVDNEAQITTRYQEITKALNQKFRNTESKTDNCLQVGSYGRWSAIKGISDLDMLYIMPASKWSDYNKDGGQSTLLKDTKEAILDRYPRTTVFVDRLVVCVQYTNFHVEVQPVFKMDDGSYKYPDTYNGGSWKITKPQDEIDEMKSMNDAKNRNLRRLCKMARAWKNKHGISMGGLLIDTLAYNFMKSTTEYDDKSYLYYDWLSRDFF

SEQ ID NO: 5741 - protein, 435 aa, Acinetobacter sp.
MSVSQMFQDFLSNIKVDNEAQITTRYQEITKALNQKFRNTESKTDNCLQVGSYGRWSAIKGISDLDMLYIMPASKWSDYNKDGGQSTLLKDTKEAILDRYPRTTVFVDRLVVCVQYTNFHVEVQPVFKMDDGSYKYPDTYNGGSWKITKPQDEIDEMKSMNDAKNRNLRRLCKMARAWKNKHGISMGGLLIDTLAYNFMKSTTEYDDKSYLYYDLLSRDFFKFLADQPDRDHYQALGSNQDVKVKSKFQEAAQDAYELCLEAIPLGSDTKAYSKWRMIYGRNFPKAPNQQASMSIRIEDIRYEHTEQFIEDQYPIDIRYKLKIESRVFQDGQFVEFLRGFKRRNKKLNHGRRLSFYIDENTTPTNLQNYSVKWKVLNRGEEAKRRNCIRGQIIWDDGSKSINEYSSFNGEHLVECYIIQNGVVVARDRIHVPIGE

SEQ ID NO: 5742 - protein, 435 aa, Acinetobacter nosocomialis
MSISQMFQDFLSNIKVDNEAQITTRYQEITKALNQKFRNTESKTDNCLQVGSYGRWSAIKGISDLDMLYIMPGSKWSDYNKDGGQSTLLKDTKEAILDRYPRTTVFVDRLVVCVQYTNFHVEVQPVFKMDDGSYKYPDTYNGGSWKITKPQDEIDEMKSMNDAKNRNLRRLCKMARAWKNKHGISMGGLLIDTLAYNFMKSTTEYDDKSYSYYDWLSRDFFKFLAEQPDRDHYQALGSNQDVKVKTKFQEAAQDAYELCLEAIPLGTDTKAYSKWRMIYGRNFPKAPSQQASLSIRIEDMRYEHTEQFIEDQYPIDIRYKLKIESRVSQDGQFVDFLRGFKRRNKKLNHGRSLSFYIDENTTPTNLQNYSVKWKVLNRGEEAKRRNCIRGQIIWDDGSNSINEYSSFNGEHLVECYIIQNGVVVARDRIHVPIGE

SEQ ID NO: 5743 - protein, 434 aa, Unknown
  Description of Unknown: Acinetobacter sequence
MSVSQMFQDFLSNLKIDNEDQITNRYQEITKALNQEFRNTESKTDNCLQVGSYGRWTAIKGISDLDMLYILPSSKWKEYEDGGQSRLLKDTKDAILKRYPRTTVFVDRLVVCVQYTNFHVEVQPVFKQEDGSYKYPDTYNGGSWKITKPQAEIDEMKVMNDAKNRNLRRLCKMVRAWKNKHGISMGGLLIDTLAYNFMKSTTEYDDKSYLYYDWLSRDFFKFLVDQPDRDHYQALGSNQDVKVKAKFQNAAQDAYDLCLEAISLGTDDKAYSKWRMIYGRNFPKAPSQKASMSIRIEDMRYEHTEQFIEDQYPVDIRYKLKIESRVTKDGEFIDFLRGFKRRRKKLNHGRSLSFYIEENTTPTNLQNYSVKWKILNRGEEAKRRNCIRGQIIWDSGNKQIEEYSSFNGEHLVECYVIQNGVVVARDRIHVPIED

SEQ ID NO: 5744 - protein, 271 aa, Acinetobacter sp.
MFQDFLSNIKVANEEQITLRYQEITCALNKKFRDTESKTSNQLQVGSYGRWTAIKGISDLDMLYIMPPSKWDDYKNGGQSKLLKDTKDAILARYPRTTVFVDRLVVCVQYTNFYVEVQPVFKQDDGSYKYPDTKNGGSWKITKPQAELDEMQNMNNAKNRNLRRLCKMARAWKNKHGVSMGGLLIDTLAYNFMKSTTYYDDKSYMYYDWLSRDFFKFLADQPDRDHYQALGSNQDVKVKAKFQDAAQDAYDLCLEADPSQNNGQYFPLKIT

SEQ ID NO: 5745 - protein, 434 aa, Unknown
  Description of Unknown: Acinetobacter calcoaceticus/baumannii complex sequence
MSISQMFQDFLSNIKVANEEQITLRYQEITCALNKKFRDTESKTSNQLQVGSYGRWTAIKGISDLDMLYIMPPSKWDDYKNGGQSKLLKDTKDAILARYPRTTVFVDRLVVCVQYTNFYVEVQPVFKQDDGSYKYPDTKNGGSWKITKPQAELDEMQNMNNAKNRNLRRLCKMARAWKNKHGVSMGGLLIDTLAYNFMKSTTYYDDKSYMYYDWLSRDFFKFLADQPDRDHYQALGSNQDVKVKAKFQDAAQDAYDLCLEAIDLGTDDKAYSKWRMIYGRQFPKAPSKQAEMSIRIEDMRYEHTEQFIEDQYPIDIRYKLKIESKVTQDGQTIDWLRGFKRRKKKLNHGRGLSFYIEENTTPKNLQNYSVRWKVLNRGEEAKRHNCIRGQIVLDDGKERIDEYSSFNGEHLVECYIIQNGVVVARDRIYVPIED

SEQ ID NO: 5746 - protein, 434 aa, Acinetobacter pittii
MSISQMFQDFLSNIKVANEEQITLRYQEITCALNKKFRDTESKTSNQLQVGSYGRWTAIKGISDLDMLYIMPYSKWEDYKNGGQSKLLKDTKDAILARYPRTTVFVDRLVVCVQYTNFHVEVQPVFKQEDGSYKYPDTKNGGSWKITKPQAELDEMQNMNNAKNRNLRRLCKMARAWKNKHGVSMGGLLIDTLAYNFMKSTTYYDDKSYMYYDWLSRDFFKFLADQPDRDHYQALGSNQDVKVKAKFQDAAQDAYDLCLEAIDLGTDDKAYSKWRMIYGRQFPKAPSKQAEMSIRIEDMRYEHTEQFIEDQYPIDIRYKLKIESKVTQDGQTIDWLRGFKRRKKKLNHGRGLSFYIEENTTPKNLQNYSVKWKVLNRGEEAKRRNCIRGQIVLDDGKERIDEYSSFNGEHLVECYIIQNGVVVARDRIYVPIED

SEQ ID NO: 5747 - protein, 434 aa, Unknown
  Description of Unknown: Acinetobacter sequence
MSISQMFQDFLSNIKVANEEQITLRYQEITCALNKKFRDTESKTSNQLQVGSYGRWTAIKGISDLDMLYIMPSSKWEDYKNGGQSKLLKDTKDAILARYPRTTVFVDRLVVCVQYTNFHVEVQPVFKQEDGSYKYPDTKNGGSWKITKPQAELDEMQNMNNAKNRNLRRLCKMARAWKNKHGVSMGGLLIDTLAYNFMKSTTYYDDKSYMYYDWLSRDFFKFLADQPDRDHYQALGSNQDVKVKAKFQDAAQDAYDLCLEAIDLGTDDKAYSKWRMIYGRQFPKAPSKQAEMSIRIEDMRYEHTEQFIEDQYPIDIRYKLKIESKVTQDGQTIDWLRGFKRRKKKLNHGRGLSFYIEENTTPKNLQNYSVKWKVLNRGEEAKRRNCIRGQIVLDDGKERIDEYSSFNGEHLVECYIIQNGVVVARDRIYVPIED

SEQ ID NO: 5748 - protein, 435 aa, Unknown
  Description of Unknown: Acinetobacter calcoaceticus/baumannii complex sequence
MSISQMFQDFLSNIKVANEEQITLRYQEITCALNKKFRDTESKTSNQLQVGSYGRWTAIKGISDLDMLYIMPSSKWDDYKDGGQSKLLKDTKDAILARYPRTTVFVDRLVVCVQYTNFHVEVQPVFKQADGSYIYPDTKNSGSWKITKPQAEIDEIQSMNDAKNRNLRRLCKMARAWKNKNGVGIGGLLIDTLAYNFMKSTTDYDDKSYSSYDCLSRDFFQFLSEQPDQNHYQALGSNQDVKVKSKFQSKAKKAYENSIKAIENEGKNSANDYWRKVYGNSFPKAATAAVKSMTLGELRYRHTEEFIENKFPIDIRYPLKIECEITKHGAFIDVLRHFKRNKKKLNSGRSLRFYIDKNGTPFNFPEQKYSVFWKVLNRGEAAKSRDCIRGQIVADLGQNQKNETADFNGEHIVECYIVQNSVVVARDRIYVPIEE

SEQ ID NO: 5749 - protein, 435 aa, Acinetobacter sp.
MSISQMFQDFLSNIKVANEEQITSRYQEITCALNKKFRDTESKTSNQLQVGSYGRWTAIKGISDLDMLYIMPPSKWDDYKNGGQSKLLKDTKDAILARYPRTTVFVDRLVVCIQYTNFHVEVQPVFEQEDGSYKYPDTKNGGSWKITKPQAEIDEMKSMNEAKNKNLRRLCKMARAWKNKHGVGIGGLLIDTLAYNFMKSTTNYDDKSYSSYDCLSRDFFKYLSEQPDQDHYQALGSNQDVKVKSKFQRKAKKAYENSLKAIENAGKSSANDYWRKVYGNSFPKAATTIVKSMTLGELRYRDTEEFIENKYPIDIRYPLKIECEITKHGAFIDFLRHFKRNRKKLNSGRSLRFYIDKNGTPSSLPEQKYSVLWKVLNRGEAAKSRDCIRGKIVADLGQNQKTETADFNGEHIVECYIVQNGVVVARDRIYVPIEE

SEQ ID NO: 5750 - protein, 437 aa, Rhizobium sp.
MSIADTFKQFLSNIAVDNDDTISLRYGEVTAALNKKFRDTDSKVSNSLQVGSYGRWTAIKGISDLDMLYIMPAGKWDSYKEGGQSRLLDDTKNAIKSRYPSTTVLKDRLVIQVLYRDFHIEVQPVFEQADGSFKYPDTYDGGSWKITKPREEIAAMKESNVQKNKNLRRLCKMARAWKNKHGLAMGGLLIDTLTYNFLKSTNEYDEKSYLYYDYMSRDFFKFLSERPDQDYYAALGSGQRVKVKKKFQKKAKKAYELALDAIAAAGSTTENEKWRKIYGRGFPAAEQAAQKAAFASSSWRNTEEFIDNRYPVDIRSSITLDCEVSQNGFRERFLREMLRLNLPLKTAKTLTFSVVDHDIQGDFNLYWKVLNRGEEARRRDCIRGQIDGDRGSMRRTEHTNFRGDHIVECYAVQNGVVVATDRIHVPIQGSQVSADAA

SEQ ID NO: 5751 - protein, 437 aa, Rhizobium sp.
MSIADTFKQFLSNIAVENDDTISLRYGEVTAALNKKFRDTDSKVSNSLQVGSYGRWTAIKGISDLDMLYIMPAGKWDSYKDAGQSRLLDDTKNAIKSRYPSTTVLKDRLVIQVLYRDFHIEVQPVFEQADGSFKYPDTYAGGSWKITKPREEIAAMKESNVQKNKNLRRLCKMARAWKNKNGLAIGGLLIDTLTYNFLKSTNEYDEKSYLYYDYMSRDFFKFLSERPDQDYYAALGSGQRVKVKKKFQKKAKKAYELALDAIAAAGSTTENEKWRKIYGRGFPAAEQAAQKAAFASSSWRNTEEFIDNRYPVDIRNSITLDCEVSQNGFRERFLREMLRLNLPLKTAKTLTFSVVDHDIQGDFNLYWKVLNRGEEARRRDCIRGQIDGDRGSMRRTEHTNFRGDHIVECYAVQNGVVVATDRIHVPIQGSQVSADAA

SEQ ID NO: 5752 - protein, 437 aa, Agrobacterium genomosp. 3
MSIADTFKQFLSNIAVDNDDTISLRYGEVTAALNKKFRDTDSKVSNSLQVGSYGRWTAIKGISDLDMLYIMPAGKWDSYKDGGQSRLLDDTKNAIKSRYPNTTVLKDRLVIQVLYRDFHIEVQPVFEQADGSFKYPDTYDGGSWKITKPREEIAAMKEANVQKNKNLRRLCKMARAWKNKHGLAMGGLLIDTLTYNFLKSTNEYDEKSYLYYDYMSRDFFKFLSERPDQDYYAALGSGQRVKVKKKFQRKAKKAYELALDAIAAAGSTTENEKWRKIYGRGFPAAEQAAQKAAFASSSWRNTEEFIDNRYPVDIRNSITLDCEVSQNGFRERFLREMLRLNLPLKTAKTLTFSVVDHDVQGDFNLYWKVLNRGEEARRRDCIRGQIDGDRGNMRRTEHTNFRGDHIVECYAVQNGVVVATDRIHVPIQGSQVSADAA

SEQ ID NO: 5753 - protein, 437 aa, Rhizobium sp.
MSIADTFKQFLSNIAVDNDDTISLRYGEVTAALNKKFRDTDSKVSNSLQVGSYGRWTAIKGISDLDMLYIMPAGKWDSYKDGGQSRLLDDTKNAIKSRYPNTTVLKDRLVIQVLYRDFHIEVQPVFEQADGSFKYPDTYDGGSWKITKPREEIAAMKEANVQKNKNLRRLCKMARAWKNKHGLAMGGLLIDTLTYNFLESTNEYDEKSYLYYDYMSRDFFKFLSERPDQDYYAALGSGQRVKVKKKFQKKAKKAYELALDAIAAAGSTTENEKWRKIYGRGFPAAEQAAQKAAFTSSSWRNTEEFIDNRYPVDIRNSITLDCEVSQNGFRERFLREMLRLNLPLKAAKTLTFSVVDHDIQGDFNLYWKVLNRGEEARRRDCIRGQIDGDRGSMRRTEHTNFRGDHIVECYAVQNGVVVATDRIHVPIQGSQVSADAA

SEQ ID NO: 5754 - protein, 437 aa, Rhizobium gallicum
MSIADTFKQFLSNIAVDNGDTISLRYGEVTAALNKKFRDTESKVSNSLQVGSYGRWTAIRGISDLDMLYIMPAGKWDDYKDGGQSRLLDDTRNAIKSRYPSTTVVKDRLVVQVLYRDFHIEVQPVFEQTDGSFKYPDTYDGGSWKITKPRDEIAAMKESNEQKNKNLRRLCKMARAWKNKHGLAMGGLLIDTLAYNFLKSTSEYNEKSYLYYDYMSRDFFKFLSERPDQDYYAALGSGQRVKVKNKFQKKAKKAYELAVDAIAAAGSTTENERWRKIYGRGFPAAEQSTQKSAFAAASWKNTEEFIENRFPIDIRNSITLDCEVSQNGFRERFLREMLRLKLPLKTAKTLTFSVIDHDIKGGFNLYWKVLNRGEEARRRDCIRGQIHGDRGNLKRTEHTNFNGDHIVECYAVQNGVVVATDRIHVPIQGNQVSADAA

SEQ ID NO: 5755 - protein, 437 aa, Rhizobium leguminosarum
MSIADTFKQFLSNIAVDNGDTISLRYGEVTAALNKKFRDTESKVSNSLQVGSYGRWTAIRGISDLDMLYIMPAGKWDDYKDGGQSRLLDDTRNAIKSRYPSTTVVKDRLVVQVLYRDFHIEVQPVFEQTDGSFKYPDTYDGGSWKITKPRDEIAAMKESNEQKNKNLRRLCKMARAWKNKHGLAMGGLLIDTLAYNFLKSTTEYNEKSYLYYDYMSRDFFKFLSERPDQDYYAALGSGQRVKVKNKFQKKAKKAYELAVDAIAAAGSTTENERWRKIYGRGFPAAEQSTQKSAFDAASWKNTEEFIENRFPIDIRNSITLDCEVSQNGFRERFLREMLRLKLPLKTAKTLTFSVIDHDIKGGFNLYWKVLNRGEEARRRDCIRGQIHGDRGNLKRTEHTNFNGDHIVECYAVQNGVVVATDRIHVPIKGNQVSADAA

SEQ ID NO: 5756 - protein, 437 aa, Rhizobium sophoriradicis
MSIADTFKQFLSNIAVDNGDTISLRYGEVTAALNKKFRDTESKVSNSLQVGSYGRWTAIRGISDLDMLYIMPAGKWDDYKDGGQSRLLDDTRNAIKSRYPSTTVVKDRLVVQVLYRDFHIEVQPVFEQTDGSFKYPDTYDGGSWKITKPRDEIAATKDSNEQKNKNLRRLCKMARAWKNKHGLAMGGLLIDTLAYNFLKSTAEYNEKSYLYYDYMSRDFFKFLSERPDQDYYAALGSGQRVKVRKKFQKKAKKAYELAVDAIAAAGLTTENEKWRKIYGRGFPAAEQSTQKSTFAAASWKNTEEFIENRFPIDIRNSITLDCEVSQNGFRERFLREMLRLKLPLKTAKTLTFSVIDHDIKGVFNLYWKVLNRGEEARRRDCIRGQIHGDRGNLKRTEHTNFNGDHIVECYAVQNGVVVATDRIHVPIQGNQVSADAA

SEQ ID NO: 5757 - protein, 437 aa, Rhizobium gallicum
MTIADTFKQFLSNIAVDNGDTISLRYGEITAALNKKFRDTESKLANSLQVGSYGRWTAIKGISDLDMLYIMPAGKWETYKDGGQSRLLNDTKNAIKDRYPTTTVLVDRLIVRVLYRDFHIEVQPVFEQADGSFKYPDTYDGGSWKITKPREEIAAMKESNDQKNKNLRRLCKMARAWKNKHGLAMGGLLIDTLAYNFMKSTDEYDEKSYLYYDYMSRDFFQYLSERPDRDYFAALGSGQRVKVKKKFQKKAKKAYELALDAIAAAGSDTENEKWRKIYGRGFPAAVQATQKAAFASSSWRNTEEFIDDRFPIDIRNNIILDCEISQNGFRERFLREMLRLNLPLKTAKTLKFSVVDHDILGEFDLYWKVLNRGEEARRRDCIRGQIHGDRGSLSRTERTDFRGDHIVECYAVQNGVVVATDRIHVPIQGNQVNADAA

SEQ ID NO: 5758 - protein, 432 aa, Burkholderia pseudomallei
MSTADIFRGFLSNLAVDNAEQIALRYGEITGALNSEFRDLDSKTSNNLQVGSYGRWTAIRGISDLDMLYIVPSSLWDDYNSAGGQSRLLTRTKDAIKARYPRTEVFVDRLVVRVLYKDFHVEVQPVFEQNDGSFKYPDTYDGGSWKITKPREEIKAIREFDEQKNKNLRRLCKMARAWKNKHGIGMGGLLIDTLAHNFLKDVPEFDDKSYLYYDWLCRDFFFFLSELPDQDYFAALGSGQRVKVKDKFQAKAKNAYDLSLKAIAEADEEKQCEKWRKIFGMPFPAAVTIQKSEARSIALDSARNTEQFIEQQYPIDIRNTLKIECDVSQNGFREARLRELLRRAMPLRIKKNLRFYVTDHNIPGSFEVYWKVLNRGPEAIRRDCIRGQIRRDSGAMSISESTDFSGDHIVECYAVKNGVVIAKDRIHVPITY

SEQ ID NO: 5759 - protein, 432 aa, Burkholderia pseudomallei; identical to SEQ ID NO: 5758

SEQ ID NO: 5760 - protein, 432 aa, Burkholderia sp.
MSTADIFRGFLSNLAVDNADQIALRYGEITGALNSEFRDLESKTSNNLQVGSYGRWTAIRGISDLDMLYVVPSSLWDDYNCTGGQSRLLTRTKDAIKARYPRTDVFVDRLVVRVLYKDFHVEVQPVFEQNDGSFKYPDTYDGGSWKITKPREEIKAIREFDEQKNKNLRRLCKMARAWKNKHGVGMGGLLIDTLAHNFLKGVTDFDEKSYLYYDWLCRDFFLFLSELPDQEYFAALGSGQRVKVKDKFQRKAKLAYDLSLKAIAEADEAKQCEKWRKIFGTPFPAAETIQKSEARNIALESARSTEQFIEQQYPIDIRNALKIECDVSQNGFREARLRELLRRAMPLRIKKNLRFYVTDHNISGSFELHWKVLNRGPEAVRRDCIRGQIRRDNGAMSISESTDFSGDHIVECYAVKNGVVIAKDRIHVPITY

SEQ ID NO: 5761 - protein, 437 aa, Burkholderia cepacia
MSTADIFKEFLTNIAIDNDDQISLRYGEITGALNSEFRDIDSKTSNNLQVGSYGRWTAIRGISDLDMLYIVPNGLWDDYNNANGQSRLLTRTKNAIKTRYPRTEVFVDRLVVRVLYKDFHVEVQPVFEQSDGSFKYPDTYDGGSWKVTKPRDEIKAIREFDENKNKNLRRLCKMARAWKNKHGVGMGGLLIDTLAHNFLKSTEDYDTRSYLYYDWMCRDFFLYLSDLPDQDYFAALGSGQRVKVKDKFTKRAKIAYELSLKAIEESDLPKQCDKWKKVFGSPFPSRTTLQKSEAVAALEAAAVFGSARNTEQYIELQRPIDVRHAIKIDCDVSQNGFREARLTEMIRRRLPLRVQKRLRFYVSDHNIPGEFEVYWKVLNRGPEAIRKDCIRGQIVRDDGTLSINESTDFSGDHIVECYAVKNGIVIAKDRILVPITY

SEQ ID NO: 5762 - protein, 437 aa, Burkholderia sp.
MSTADIFKEFVANLAVDNDDQISMRYGEITGALNSEFREIDSKTSNNLQVGSYGRWTAIHGISDLDMLYIVPAGLWDEYNNTNGQSRLLTRTKDAIKARYPRTDVFVDRLVVRVLYKDFHVEVQPVFEQKDGSFKYPDTYDGGSWKITKPRDEIKAIREFDDNKNQNLRRLCKMARAWKNKHGVGMGGLLIDTLAHNFLKGTKDYDTKSYLYYDEMCRDFFLYLSDLPDQEYFAALGSGQRVKVKDKFQKRAKISYDLSLKAIEETNLPKQCEKWKKVFGSPFPSRVALQKSAAVAALEAAAIFGSARNTEQYIELQRPIDIRHALKIDCDVSQNGFREARLTEMIRRRLPLRVQKRLRFFVSDHNIPGQFDIYWKVLNRGPEAIRRDCIRGQITRDDGTHSISESTDFSGDHIVECYAVKNGVVIAKDRIHVPITY

SEQ ID NO: 5763 - protein, 384 aa, Pseudomonas aeruginosa
MSISEKFQGFLSNLRITNDDQISLRYGEITAALNKEFRDTESKTANNLQVGSYGRWTAIQGISDLDMLYIMPAKSWNDYNVSGGQSKLLEKTKDIIKARYPRTDIYVDSPVVRVLYTNFHVEVQPVFEQEDGSFKYPDTSGDGSWKITKPREEITEIAKINGEKNRNLRRLCKMARAWKNKHGINMGGLLIDTLAHNFLKSTNYYDDKSYLYYDWMGRDFFYYLSELPEQDYYAALGSGQRVKVKKKFQKPAKKAYDLCVEAIAAADTDSEDEKWRKVYGRPFPAPQKASRAALESIASGVRYDETEQYIENRFPIDIRSSLRIECEVSQNGFREFLLRDMIARRIRLSVSKKLRFYIEECSVRKPYSVYWKVLNRGAEAQRKN

SEQ ID NO: 5764 - protein, 432 aa, Pseudomonas aeruginosa
MSISEKFQGFLSNLRITNDDQISLRYGEITAALNKEFRDTESKTANNLQVGSYGRWTAIQGISDLDMLYIMPAKSWNDYNVSGGQSKLLEKTKDIIKARYPRTDIYVDSPVVRVLYTNFHVEVQPVFEQEDGSFKYPDTSGDGSWKITKPREEITEIAKINGEKNRNLRRLCKMARAWKNKHGINMGGLLIDTLAHNFLKSTNYYDDKSYLYYDWMGRDFFYYLSELPEQDYYAALGSGQRVKVKKKFQKPAKKAYDLCVEAIAAADTDSEDEKWRKVYGRPFPAPQKASRAALESIASGVRYDETEQYIENRFPIDIRSSLRIECEVSQNGFREFLLRDMIARRIRLSVSKKLRFYIEECSVRKPYSVYWKVLNRGAEAQRKNCIRGQIVSDSGRGEITEHTSFNGDHIVECYIVKNGVVVAKNRIHVPIQ

SEQ ID NO: 5765 - protein, 425 aa, Burkholderiales bacterium
MSIADSFKQFLTNIKVPNHDQIELRYGEITAALNKAFRDSESKTSNNLQVGSYGRWTAIKGVSDLDMLYVVPASLWETYKDGGQSKLLERTKAAIKARYPRTEVYVDRLVVRVLYKDFHVEVQPVFEQADKSFKYPDTYSGGRWKITKPRDEISAMTEFVSEKNKNLRRLCKMARSWKNKHGVGMGGLLIDTLAHNFLRDTKEYDNKSYLYYDYMSRDFFKYLSELPKQDYFAALGSGQRVRVKSNFQKSAKKAHELAIAAIEAAGKDNESAKWQKIYGKDYPDAVAKAEAAAERYGHRSSEQFVEDLWPVDIRYPLQIECEVTQNGFRETLLREFLRRRLPLRRQKKLRFFIESCGVPGDYTILWKVLNRGDEAFRRKCTRGTISRGGKEITETTDFNGDHIVECYIVKDGVVVAKDRIHVPIE

SEQ ID NO: 5766 - protein, 428 aa, Herbaspirillum sp.
MGIGEKFKQFLSNIKIENDAQIELRYGEITAALNQEFRDSDSKTANNLQVGSYGRWTAINGVSDLDMLYIVPASQWDKYQDGGQAALLKRTKDAISARYPRTEIYVDRLVVRVLYTDFHVEVQPVFEEADKSFKYPDTYSGGKWKITKPREEISAMTEFMVQKNKNLRRLCKMARAWKNKHGVGMGGLLIDTLAHNFLRDTDYYDDKSYLYYDFMSRDFFKYLSDLPRQDYYAALGSGQRVRVKSYFQRPAKKAYELALKAIEAAGKDNESAKWQKIYGRDFPLSEEKSLIKASVENYHGHTSTEQFVENLWPVDIRYNLQIECEVSQNGFRDYLLREFLLKKLPLAKRKKLRFYIDSCDVPGAYTILWKVLNRGDEAFRRKCTRGTINRGGNEIVETTDFHGDHIVECYIAKNGVIVAKSRIHVPIE

SEQ ID NO: 5767 - protein, 433 aa, Orrella dioscoreae
MKEQTLSIAEKFKQFLSNIKVQNDAQIELRYGEITSALNKEFRDTESKTSNNLQVGSYGRWTAIKGISDLDMLYIVPASQWEKYKDGGQSALLERTKSAIKARYPRTDMYVDRLVVRVLYTNFHVEVQPVFEQEDGSFKYPDTYNGGSWKTTKPRAEISAMTEFVASKNKNLRRLCKMVRAWKNKHGVGMGGLLIDTLAHNFLRDTKDYDEKSYLYYDWMSRDFFKYLSELPRQDYYAALGSGQRVRVKAAFQKPAKKAYELALKAIDAAGKDNESAKWQKIYGREFPNAEIVAKASASLESFDGYRSTEQFVEDLWPVDIRYSLRIDCEVSQNGFRDYLLREFLGRRLPLKRRKSLRFFIESCDVPGNYKILWKVLNRGEEAFRRKCTRGSINTGGKEIVERTDFHGDHIVECYIAKEGVIVAKDRIHVPIE

SEQ ID NO: 5768 - protein, 428 aa, Orrella dioscoreae
MSIAEKFKQFLSNIKVQNDAQIELRYGEITSALNKEFRDTESKTSNNLQVGSYGRWTAIKGISDLDMLYIVPASQWEKYKDGGQSALLERTKSAIKARYPRTDMYVDRLVVRVLYTNFHVEVQPVFEQEDGSFKYPDTYNGGSWKTTKPRAEISAMTEFVASKNKNLRRLCKMVRAWKNKHGVGMGGLLIDTLAHNFLRDTKDYDEKSYLYYDWMSRDFFKYLSELPRQDYYAALGSGQRVRVKAAFQKPAKKAYELALKAIDAAGKDNESAKWQKIYGREFPNAEIVAKASASLESFDGYRSTEQFVEDLWPVDIRYSLRIDCEVSQNGFRDYLLREFLGRRLPLKRRKSLRFFIESCDVPGNYKILWKVLNRGEEAFRRKCTRGSINTGGKEIVERTDFHGDHIVECYIAKEGVIVAKDRIHVPIE

SEQ ID NO: 5769 - protein, 428 aa, Duganella zoogloeoides
MSIANKFKQFLSNLKVDNDEQIELRYGEITSALNKEFRDSESKTSNNLQVGSYGRWTAIKGISDLDMLYIVPASQWDNYKNGGQSALLERAKAAIKLRYPRTEMYVDRLVVRVLYKNFHVEVQPVFELDDGSFKYPDTYKGSSWKITKPREEISAMTEFVTEKNKNLRRLCKMSRAWKNKHGVGMGGLLLDTLAHNFLRDTKDYDDKSYLYYDWMSRDFFKYLSELPQQDYFAALGSGQRVRVKSKFQKQAKKAYELALKAIEAADKDNETAKWQKIYGRDFSDVVAKSEASASLERYHDFISTEQFVEDLWPVDVRYSLCIECEVSQNGFREYLLREFLRRRLPLNRKKKLRFYIDSCDVPGNYKILWKVLNRGEEAFRRKCTRGTINAGDKEIVEETDFHGDHIVECYIEKEGVIVAKDRIHVPIE

SEQ ID NO: 5770 - protein, 427 aa, Pectobacterium wasabiae
MSIAEKFQTFLENIKIDNGEQISGKYGDITSCLNKRFRNTDSSIANNLQVGSYGRWSAIRGISDLDMIYIMPASKWDDYNIDGGQSKLLTAVKDTLKARYPRTDIYVDSPVVRVLYTNFHVEVQPAFEQEDGSFKFPDTRKGGTWKITKPRAEIKAMADANAEKNRNLRRLCKMARAWKNKHGVAMGGLLIDTLAHNFLNSTTEYDSRSYFYYDWLSRDFFKYLADEPKKERYAALGSGQHVKVKESFQTAASKAHQLCLEAIDASGTDGENAKWQKVYGNRFPASEKQIAKASARSFRETEEFVEDRFPVDIRYKLKIDCEVTQAGFQPGKLRSMLRRNFKLSPKKSLKFEAIDNTVPGNSQMYWKVLNRGEEAERRDCLRGQIVKDSGHSTISEHTNFAGDHIVECYVVQNGVVVAKDRIHVPIE

SEQ ID NO: 5771 - protein, 427 aa, Pseudomonas sp.
MSIAEKFETFLSNIKIDNDEQIGSRYGDITACLNKSFRDTSSATANNLQVGSYGRWTAIRGVSDLDMIYIMPAGKWDSYNVVGGQAKLLSDTKDALKNRYPRTDIYVDSPVVRVLYTNFHVEVQPAFEQVDGSFKFPDTRNGGSWKLTKPRAEIEAMKNTNVEKNRNLRRLCKMARAWKNKHGVAMGGLLIDTLAYNFLKSTDAYDTRSYLYYDWMSRDFFKYLADEPEKERYAALGSGQHVKVKDAFQSAAGKAYDLCVKAIAAADSDTENAKWQKVYGARFPAPEKLIAKASNRVFRETEEFVEDRFPIDIRYKLKIDCEVTQNGFQPRRLRGMLGKNFKLSAQKSLKFEVSDIKVPGTYDVYWKVLNRGDEAERRDCIRGQIVADGGHQTVSEHTNFAGDHIVECYAVKNGVVVAKDRIHVPIE

SEQ ID NO: 5772 - protein, 427 aa, Unknown
  Description of Unknown: Pseudomonas sequence
MSIAEKFQTFLSNIKIDNDEQISCRYGDITSCLNKYFRDTSSSTANNLQVGSYGRWTAIRGVSDLDMIYIMPSGKWDDYNVVGGQAKLLSDTKDALKARYPRTDIFVDSPVVRVLYTNFHVEVQPAFEQDDGSFKFPDTRNGGSWKVTKPRAEIEAMKEANIEKNRNLRRLCKMARAWKNKHGVAMGGLLIDTLAYNFLKSTDSYDTKSYLYYDWMSRDFFKYLADEPEKERYAALGSGQHVKVKESFQKAAEKAYDLCIKAIAAAGNDTENAKWQKVFGTRFPAPEKQIAKASDRVFRETEEFVEDQFPVDIRYKLKIDCEVTQNGFQPRTLRSMLGKNFKLSAQKSLKFEVVDIKVPGSYDMYWKVLNRGDEAERRDCIRGQIVADGGRQTVSEHTNFAGDHIVECYAVKNGVVVAKDRIHVPIE

SEQ ID NO: 5773 - protein, 429 aa, Unknown
  Description of Unknown: Pseudomonas sequence
MSIADKFKNFLDNIKVSNDEQISSRYGEITLALNKEFRDSESSTANNLRVGSYGRWTAIKGISDLDMLYIMPAGKWQDYKDGGQSKLLQDTKNAIKARYPRTDIFVDSPVVRVLYINFHVEVQPVFKQDDGSYLYPDTRNGGSWKTTKPREEMDAMKAVNEDYNHNLRRLCKMARAWKNKHGVGMGGLLIDTLAHNFIKSNDDYKEKSYLYYDWMSRDFFKFLADQPDKDYYAALGSGQRVKVKEKFQKAASKAYDLCLKAIEDNGKDTENAKWQKIYGRQFPAAVVVEKAEASTYEQDYRRTEEFVEDSYSIDVRAKLRIDCEVTQNGYRPDSLRNMLLNRFKLSPKKTLKFYIVENDTAGDYEVYWKVLNRGDEAKRRDCVRGQIVQDSGLRKIEEHTSFSGDHIVECYIVKNNVVVAKDRIHVPIE

SEQ ID NO: 5774 - protein, 429 aa, Pseudomonas aeruginosa
MSIADKFKSFLDNIKVSNDEQISSRYGEITLALNKEFRDSESSTANNLRVGSYGRWTAIKGISDLDMLYIMPAGKWQDYKDGGQSKLLQDTKNAIKARYPRTDIFVDSPVVRVLYTNFHVEVQPVFKQDDGSYLYPDTRNGGSWKTTKPREEMDAMKAVNEDYNHNLRRLCKMVRAWKNKHGVGMGGLLIDTLAHNFIKSNDDYKEKSYLYYDLMSRDFFKFLADQPDKEYYAALGSGQRVKVKEKFQKAASKAYELCLKAIEDNGKDTENAKWQKIYGRQFPAAVAVEKAEASTYEQDYRRTEEFVEDSYSIDIRAKLKIDCEITQNGYRPDSLRNMLLNKFKLSPKKSLKFYIVENDTAGDYDVYWKVLNRGNEAKRRDCVRGQIVQDSGLRRIEEHTSFSGDHIVECYIVKNNVVVAKDRIHVPIE

SEQ ID NO: 5775 - protein, 429 aa, Pseudomonas syringae
MSIADKFKSFLDNIKVSNDEQISDRYGEITLALNKEFRDSDSSTANNLRVGSYGRWTAIKGISDLDMLYIMPAGKWDDYKNGGQSKLLQDTKNAIKARYPRTDIFVDSPVVRVLYTNFHVEVQPVFKQDDGSYLYPDTRNGGSWKTTKPREEMDAMKTVNEDYNRNLRRLCKMVRAWKNKHGVGMGGLLIDTLAHNFIKANDDYKEKSYLYYDWMSRDFFKFLADQPDKEYYAALGSGQRVKVKEKFQKSANKAYELCLKAIEDNGNDTENAKWQKIYGRQFPSAVVVEKAEASTYKQDYKRTEEFVENSYSVDIRNKLRIDCEVTQNGYRPDSLRNMLMRSFKLSPKKSLKFNIVENDTAGDYDVYWKVLNRGDEAKRRDCVRGQVVQDSGLEKIEEHTNFSGDHIVECYIVKNNVVVAKDRIHVPIE

SEQ ID NO: 5776 - protein, 438 aa, Rhizobiales bacterium
MSIADTFKQFLRNLAVDNAQAISDQYGEITCALNKKFRDTESKIANTLQVGSYGRHTAIKGISDLDMLYIMPRGEWDNYKNGGQSKLLSDVAVAIRARYPRTTVRVDRLVVQAVYSNFTVEAQPVFEQDDGSFRYPDTYNGGSWKITKPREEIKAMSEFVAEKNDNLRQLCKMARAWKNKHGVGIGGLLTDTLAHNFLKSTSEYDDKSYLYYDYMSRDFFAYLKELPKQDYFAALGSGQRVKVKRQFQRKAKKAYELCLKAIEADGKDNQNDKWRAVYGRLFPAAEKMLKSALTDRAGHAVRMTEEFPDEVFAAIDIRNNIRIDCQVEQSGFRPASLREMLRHRTLLMPRKKLTFSVVETDIAGSYELFWKVLNRGQESINRDCVRGQIVADDGHKRKVERTNFKGDHVVECYALVDGVVVATDRIHVPISANQEDDE

SEQ ID NO: 5777 - protein, 439 aa, Microvirga lupini
MSIADTFKQFLNNLVVDNAQTISDRYGEITCALNKKFRDTESKTANTLQVGSYGRHTAIKGISDLDMLYIMPKGEWDNYKNDGQSKLLSDAAAAIRARYPNTTVRVDRLVVQAIYSNFRVEAQPVFEQDDGSFKYPDTYNGSAWRITKPREEIQAMSEFDTQKNKNFRRLCKMARAWKNKHGVGIGGLLIDTLAHNFLSSTKEYDEKSYLYYDYMSRDFFAYLKELPKQDYFAALGSGQRVKVKKDFQRKAKKAHELCLKAIEAEGKDSQNDKWRAVYGRLFPAAEKVQKAALVERAGRAVRMTEEFPEDVFSAIDIRNNIRIDCKVEQNGFRPASLREMLRDRTLLMPRKKLTFSVVETDIPGSYGLFWKVLNRGQEAIDRDCIRGQIVADDGHKRKVEHTNFRGDHVVDCYAIVDGVAVATDRIHVPIRANQEDYDE

SEQ ID NO: 5778 - protein, 439 aa, Serratia marcescens
MSIADIFQRFLRNLAVDNAQTISDRYGEITCVLNKKFRDTESKTANTLQVGSYGRYTAIKGISDLDMLYIMPKSEWDNYKDGGQSRLLSDSANAIRARYPNTIVKVDRLVVQVIYSNFRVEAQPVFEQDDGSFKYPDTYNGGAWKITKPREEIRAMSEFDTQKNRNLRRLCKMVRAWKNKHGVGVGGLLIDTLAHNFLKSNSDYDDKSYFYYDYMSRDFFAYLSELPKQDYYAALGSGQRVKVKKNFQRKAKKAHELCLKAIEAEGKDNQSDRWRAVYGRPFPAGEEVQKAELAERVGHLVHTTEEYAEDVFGAIDIRNNIRIDCQVEQNGFRPASLRDMLNNRALLMPRKKLTFSVAETDITGPYSLFWKVLNRGQEAFKRDCIRGQIVADEGYKSNVERTNFKGDHVVECYAVVDGVVVATDRIHVPISTNQEDLNE

SEQ ID NO: 5779 - protein, 439 aa, Sphingopyxis sp.
MSISDTFKKFIGNLALDNAENISQRYGEITCALNKKFRDAESKTANSLQVGSYGRHTAIKGISDLDMLYIMPKDEWDNYKDGGQSKLLTDAAAAIRARYPTTTVKVDRLVVQVVYSNYTVEAQPVFEQDDGSFKYPDTYNGGSWKITKPKEEIQAMSEFDAQKNKNLRRLCKMARAWKNKHGVGIGGLLIDTLAHKFLQSTADYDEKSYLYYDYMSRDFFSYLKELPKKDYFAALGSGQRVKVKKQFQRKARKAYDLCLKAINAEGKDSQNDKWRAVYGRQFPAAQKVAKAAIAESAGRTFRNTEEFAEDVFLGIDIRRNISIDCKVEQAGYRPASLRDILSTGKFLNPRKKLTFSVVSSDIDGPYGLFWKVLNRGPEAESRDCIRGQIVGDEGYKKNVEHTNFKGDHVVECYAVLNSVVIATDRIHVPISANQEDCDD

SEQ ID NO: 5780 - protein, 436 aa, Sphingomonas sp.
MGIGEVFKEFIGNLAVDNAQSISDRYGEITSALNKAFRDTESKTANTLQVGSYGRWTAIHGISDLDMLYIMPKGQWATYDKEGGQAKLLSDAAAAIKGRYPKTDIGVDRLIVRVRYSNFHVEAQPVFQMEDGSFKYPDTYRGGHWKITKPLEEMAAMSEFDQQKNKNLRRLCKMARAWKNKHGVGMGGLLIDTLAHKFIQSTAQYDDKSYLYYDLMSRDFFQYLSNLPKQEYFMALGSGQRVKVKANFRKKAAKAYDLCLKAIAAEGTDKQNDKWKAVFGRPFPSQVKVAKAALSEARFRHTEEFVENSLRVDVRYNITIDCDITQDGFRPASLRDMLTRGVFLQPRKRLHFSVTTTDVPGQFGLFWKVLNRGPEAEKRDMIRGQIVADKGHREIVEYTTFKGDHVVECYAVQYGVVVATDRIHVPISSNSDDDDG

SEQ ID NO: 5781 - protein, 435 aa, Methylobacterium sp.
MSISDAFKTFLDNIKVDNADTISNRYDEITYALNLEFRNTDSKTADSLRVGSYGRYTAIKGISDLDMLYIVPSSCWATYENNGQGDLLTKVCRTIGSRYPRTTVKVDRLVVQVLYADFQVEVQPVFEMPDGSFKYPDTYNGGSWKITKPRDEIAAMKQFGAEKNENLRRLCKIARAWKNKHGVAMGGLLIDTLCYNFLSQNSDYDDKSFLYYDWMSRDFFKYLSEQNKQDYYAELGSRQRVRVKKDFRSKASKAYELCLKAIEAEGEIYRNERWRRVYGRGFPPRPDKVVKENVVAMDAYEAPNTEQFIDDLFPVDVRYDIELECEVTQRGFRPSLLRTLLANVRHLRIDKSLRFHIAASSVPEPYDLYWKVMNRGPLAVRRKAIRGQIIRDGGHRERKESTDFKGDHIVECYAVKNGVVVATDRIDVPISNTRE

SEQ ID NO: 5782 - protein, 441 aa, Oceanibulbus indolifex
MGTSEDFKTFLDNIKIDNAATIALRYGEVTASLNKEFRDTESKTANSLQVGSYGRWTAIKGISDLDMIYIMPAGKWDSYKDGGQYRLLHDAKAAIKRRYPSTTVKVDRLVVRVLYNDFHIEVMPAFKLADGSYKYPDTANGGSWKNTKPQAELDEMREANERKNRNLRRLCKMARAWKNKHGVAMGGLLIDTLAYNFLESTDEYDTKSYHYYDYMCRDFFEFLADQPKQSEYAALGSRQRVRVKKRFERKAKKAYDLCLKAIDASGQKNERQKWRDVFGNAYPAPAKSAAGEAAAFAHVFKNTEQFVEDRFPVDIRYHLRINCEVTQDGFRPGMLRDLLERHGVLLPKKSLRFFIADATDLPDDTELFWKILNRGEEAERRDVIRGQIVRDEGRGERQETTNFRGDHLVECYAVSRGVVVARDNIHVPIRVKDAEDEDYAA

SEQ ID NO: 5783 - protein, 441 aa, Roseovarius sp.
MGISDDFKTFLDNIKIDNAATIALRYGEVTASLNKEFRDTESKTANSLQVGSYGRWTAIKGISDLDMIYIMPAGKWDTYKEEGQNRLLHDARDAIKRRYPSTTVKVDRLVVRVLYNDFHIEVMPAFKLADGSYKYPDNAKGGSWKITKPQAELDEMREANERKNRNLRHLCKMARAWKNKQGVAMGGLLIDTLAYNFLESTDEYDTKSFHYYDYMCRDFFKFLADQPKQSEYAALGSRQRVRVKKRFERKAKKAYDLCVKAIDASGQKNERQKWRDVFGNAYPAPVRSAAGEAAAFAHVFKNTEQFVEERFPVDIRYHLRINCEVTQDGFRPGMLRDLLERHGVLLPKKSLRFFIADATDLPDDAEVFWKVLNRGEEAERRDMIRGQIVRDEGRGERRETTNFRGDHLVECYAVSRGVVVARDTVRVPIRVRDAEDEDYAA

SEQ ID NO: 5784 - protein, 441 aa, Pararhizobium antarcticum
MGIANDFKTFLDSIKIDNADTIALRYGEVTAALNKEFRDTESKSANSLQVGSYGRWTAIKGISDLDMIYTIPAAKWDTYKNGGQYSLLRDAKDAIKRRYPSTTVKVDRLVISVLYKDFHIEVMPAFKLTDGSFKYPDTASGGSWKISKPQAELDEMREANARKNRNLRRLCKMARAWKNKHGVAMGGLLIDTLAYNFLESTDEYDMRSHYYYDYMCRDFFKFLADQPKQSEYAALGSRQRVSVKKRFERKAKNAYDLCLKAIEASGQTNERQKWRDVFGNAYPAPAKSAAGETAAFDHVFRNTEEFIEDNFPVDVRYHLRINCEVTQDGFRPGMLRSLLEGHGILLPKKSLRFFIADAADVPDGVELYWKVLNCGDEAERRDMIRGQIVRDHGRGECKETTNFRGNHLVECYAVQRGVVVARDIIRVPIDARSVEDTEDAA

SEQ ID NO: 5785 - protein, 442 aa, Unknown
  Description of Unknown: Rhodobacteraceae sequence
MSISDDFKAFLENIQVDNAETISLRYGEVTAALNKQFRDTESKTANSLQVGSYGRWTAIKGVSDLDMIYIMPAGKWDDYKNSGQTKLLQDTKEAIKRRYPSTTVRVDRLVVRVLYKDFHIEVMPAFKQDDGSYKYPDTANGGSWKITKPQAEIDEMREANKRKNRNLRRLCKMARAWKNKHGVAMGGLLIDTLAYNFLESTDEYDDRSYYYYDWMCRDFFKFLADQPKQSEYAALGSRQRVRVKKRFETKAKKAYDLCVKAIEASGQKNERQKWRDVFGNAYPAPVTKSAAGESAAYSHVFRDTEQFVEDRFRVDIRHHLRINCEVTQNGFRPTMLRELLEGYGILRPQKELRFFLSDTSDLPDDIELYWKVLNRGDEAERRDMIRGQIVRDDGRGERRETTNFRGDHLVECYAVSRGVVIARDMIRVPIRVRDAEDEDYAA

SEQ ID NO: 5786 - protein, 442 aa, Sulfitobacter pseudonitzschiae
MSISDDFKAFLENIQVDNAETISLRYGEVTAALNKQFRDTESKTANSLQVGSYGRWTAIKGLSDLDMIYIMPAGKWDDYKNSGQTRLLQDTKEAIKRRYPSTTVRVDRLVVRVLYKDFHIEVMPAFKQDDGSYKYPDTANGGSWKITKPQAEIDEMREANKRKNRNLRRLCKMARAWKNKHGVAMGGLLIDTLAYNFLESTDEYDDRSYYYYDWMCRDFFKFLADQPKQSEYAALGSRQRVRVKKRFETKAKKAYDLCVKAIEASGQKNERQKWRDVFGNAYPAPVTKSAAGESAAYSHVFRDTEQFVEDRFRVDIRHHLLINCEVTQDGFRPTMLRELLEGYGILRPQKELRFFLSDTSDLPDDIELYWKVLNRGDEAERRDMIRGQIVRDDGRGERRETTNFRGDHLVECYAVSRGVVIARDMIRVPIRVRDAEDEDYAA

SEQ ID NO: 5787 - protein, 442 aa, Ruegeria mobilis
MSISDDFKAFLENIQVDNSDTISLRYGEVTAALNKRFRDTESKTANSLQVGSYGRWTAIKGVSDLDMIYIMPAGKWDDYKSGGQTKLLQDTKEAIKRRYPTTTVRVDRLVVRVLYNDFHIEVMPAFKQDDGSYKYPDMANGGSWKITKPQAELDEMREANKRKNRNLRRLCKMTRAWKNKHGVAMGGLLIDTLAYNFLESTDEYDERSYYYYDWMCRDFFEFLAGQPKLSEYAALGSRQRVRVKKRFETKAKKAYDLCVKAIEASGQKNERQKWRDVFGNAYPAPVTKSAAGESAAYSHVFRGTEQFVEDRFRVDIRHHLRINCEVTQDGFRPTMLRELLEGYGILRAQKQLRFFLSDTSDLPDDIELYWKVLNRGDEAERRDMIRGQIVRDDGRGERRETTNFRGDHLVECYAVSRGVVIGRDMIRVPIRVRDAEDEDYAA

SEQ ID NO: 5788 - protein, 441 aa, Paracoccus yeei
MSIADDFKTFLDNIKIANAETIGLRYGELTSALNKEFRDTESKTANSLQVGSYGRWTAIKGISDLDMIYVMPAGKWETYKDGRQYELLRDTRDAIKRRYPSTTVKVDRLVVRVLYKDFHVEVMPAFELADESYKYPDTANGGSWKITKPQAEINEIRKANDRKNRNLRRLCKMVRAWKNKHGVAMGGLLIDTLAYNFLESTDEYDTKSYYYYDWMCRDFFKFLADQPNQSEYAALGSRQRVRVKKRFERKAKKAYELCLKAIEASGQKNERQKWRDIFGNAFPAPAKSVAGEAAAHAHVFKNTEEFVEDRFAVDIRYDLRINCEVTQDGFRPTMLRQLLEDYGILRAQKKLRFFLADISDLPDEVDFYWKVLNRGNEAERRDMIRGQILHDQGRSERHETTSFRGDHLVECYAVSRGVVVARDAIRVPIRAGDAQDENYDA

SEQ ID NO: 5789 - protein, 439 aa, Afifella marina
MSIADDFKTLLSNIQVANADTIALRYGEITAVLNKEFRDTESKTANSLQVGSYGRWTAIKGISDLDMIYIVPASKWETYKNGGQYALLRDTKDAIKARYPATTVKVDRLVVRVLYKDFHIEVMPAFRENDGSYKYPDTNSGGSWKITKPQAELDEMRAANVRKNRNLRRLCKMTRAWKNKHGVAMGGLLIDTLAYNFLESTEEYDTKSYFWYDYLCRDFFKYLADQPKQSEYAALGSRQRVRVKKRFEKKAAEAYELCKKAIAASGQKNERQKWRAVFGNGYPAPEAVSEDAVATSVAKAEFRYTEEFVENRFPIDIRYDLQINCEVTQNGFRPTMLLDLLGRHGILLRRKSLRFFVADGSDLPEDAALYWKVLNRGEEAERRDEIRGQILKDDGHWERQERTSFRGNHLVECYAVQNGVVVARDSVLVPISAEVAAAA

SEQ ID NO: 5790 - protein, 454 aa, Acetobacter pasteurianus
MIVLRWGHRAAHQREAAISRADNFKTLFSNIAIDNEDTIALRYGEVTRACNLQFRDTDSRTANSLQVGSYGRWTGIRGISDLDMLYIMPTRKWDTYKGNPYRLLRDTADAIRNRYRTTEVYVDTLVVVCKYNNFKIEVQPVFEDTEGFRYPYTKNGGSYRLTKPREEISATRTVDADNNGNLRRLCKMTRAWKNKHGVAMNGLVIDTLAHNFLLTTTDFDKSTFSTCGQMMRDFLEYLSNQPKQERYHALGSGQHVKVHKRFEGKAKKGLELADKALEAGEEAKANNRWRKVFGNGYPLSDKTEAKKGHITEASYTATNTEEFIEDMFPVDIRYSLRLECEVKQNGFRTILLRAMRGVAMKRLNVYRSKSLKFYIASDNIKGIYHVYWKVLNRGSEAIRLDKIRGQIEADRGSKTKIERSAFRGEHVVDCYAVQDGVVVAKDRIHVPIVDESES

SEQ ID NO: 5791 - protein, 437 aa, Acetobacter pasteurianus
MSRADNFKTLFSNIAIDNEDTIALRYGEVTRACNLQFRDTDSRTANSLQVGSYGRWTGIRGISDLDMLYIMPTRKWDTYKGNPYRLLRDTADAIRNRYRTTEVYVDTLVVVCKYNNFKIEVQPVFEDTEGFRYPYTKNGGSYRLTKPREEISATRTVDADNNGNLRRLCKMTRAWKNKHGVAMNGLVIDTLAHNFLLTTTDFDKSTFSTCGQMMRDFLEYLSNQPKQERYHALGSGQHVKVHKRFEGKAKKGLELADKALEAGEEAKANNRWRKVFGNGYPLSDKTEAKKGHITEASYTATNTEEFIEDMFPVDIRYSLRLECEVKQNGFRTILLRAMRGVAMKRLNVYRSKSLKFYIASDNIKGIYHVYWKVLNRGSEAIRLDKIRGQIEADRGSKTKIERSAFRGEHVVDCYAVQDGVVVAKDRIHVPIVDESES

SEQ ID NO: 5792 - protein, 437 aa, Sphingomonas sp.
MSRADDFKTLFSNIAIDNEATISSRYGEVTRACNLQFRETDSRTANSLQVGSYGRWTGIRGISDLDMLYIMPSGKWEKYKDKPYQLLRDTADAIQARYTSTTVYVDTLVVVCQYQNFKIEVQPVFEDEEGFWYPYTKGQGCYRVTKPRPELATTQQVNTDKNGNLRRLAKMTRAWKNKHGVGMGGLLIDTLAHNFLVSRTEYDKTALNSCGQMMRDFLSFLSEEPKKDRYAALGSGQHVKVHKAFQSKAKKGLALADKALEAGEDAKANNRWRKLFGRTYPASAATEVKKAQLTEAGYTADNTEEFIEDLFPVDIRYSLRLECEIKQSGFRTVLLRAMRGVGARRPNVYKSKSLRFYIEKENIKGIYHVYWKVLNRGPEAIRRDIIRGQIVPDSGNKTKRETSDFRGEHVVDCYAVQDGVVVAKDRIHVPIVDESEK

SEQ ID NO: 5793 - protein, 437 aa, Sphingomonas sp.
MSRADDFKTLFSNIAIDNEATISLRYGEVTRACNLQFRDTDSRKDNSLQVGSYGRWTGIKGISDLDMLYIMPAGKWDTYKNDPYKLLRHTADAIQERYKTTTVYVDTLVVVCEYQNFKIEVQPVFEDEEGFWYPYTKGRGTYRLTKPRPELDTTTKVDGDKNGNLRRLARMARAWKNKHGVGMGGLLIDTLAHNFLVGRDTYDKTAFASCGQMMRDFLSFLAEQPKQDRYEALGSGQHVKVHKPFQSKAKKGLELADKALEAGEEAKANNRWRKLFGRAYPLSDATEVRKSQITEASYTADNTEEFIEDKFPVDIRYSLRLECEVKQSGFRTVLLRAMSSAGMKRLNVYKSKQLKFYIVSENIKGIYIVYWKVLNRGSEAVRRNMIRGQIVPDSGNKIKKETSDFRGEHVVECYAVQNGVVVAKDRIHVPIVDESEQ

SEQ ID NO: 5794 - protein, 439 aa, Sphingobium sp.
MSRTEDFKTLFANIAIDNADTISKRYGEVTRALNLEFRDTESRTANSLQVGSYGRWTAIKGISDLDMLYIMPKRCWNDYKDGGQYKLLRKAADAILERYPDTEVYPDTLVVVIQYTNFKIEVQPVFAEDDGSYTYPYTKNGGSWRTTKPQAELNTTSSVDSDKNGNLRRLAKMTRAWKNKHGVAMGGLLIDTLAHNFLKSNSDYDKTMFGSCGQMMRDFLSYLTDQPKQDRYAALGSGQHVKVHKRFQGKAKKGLELADKALEAGEEAKANNRWRKLFGRGYPAAQAEVKKAYIVEAGYQARNTEEFIEDRFPVDIRYALRLDCEVSQHGFRTIHIRAASRMLGIKRLNVFKSKSLHFHIADHNIEGIFHVYWKVLNRGPMAIERDMIRGQIDKDSGSKTKHETSSFRGEHVVDCYAVQHGVVVAKDRIHVPILDQSES

SEQ ID NO: 5795 - protein, 435 aa, Porphyrobacter sp.
MSISTAFSDFLDNIAIDNAETISLRYGEVTRALNMRFRDTESRTANTLQVGSYGRRTAIKGVSDLDMLFIMPASKWDDYSNGGQSKLLTDAANAIKARYPNTTVKVDRLVVQIQYQGFQIEAQPVFKLVDGSFRYPDTYRGGSWKTTKPEQELTASSQAQLDKNNNFRPLCKMVRAWRNRHGVQMGGLLIDTLVYKFLYSTSEYDSAGYRSYPQMVEAFFAYLADLPVQHEYGALGSNQRVKVKKRFQRRAREAQEAAAKAAAEVDEAKARAKWRKLFGRAFPLAEEGIAESVIYEAGYQARNTEEFPEEVFSVDIRYTLKIDCEVKQNGFQTLLLRAMLVDHLPLFTQKSLRFKIVHHDIPESIDHQFYWKVLNRGPVAVKRDCIRGQIVPDEGQRQKIENTNFRGDHIVECYAVSNGVVIARDRIKVPIREEA

SEQ ID NO: 5796 - protein, 434 aa, Asticcacaulis sp.
MSTADNFKTFLDNIRIDNKEIISGRYGEITCALNRTYRDTESKTANSLQVGSYGRKTAIKGVSDLDMLYILPEAVWEDYNVPKGQAKLLRHVKEAILYRYPTTNVVVDTPVVRVLYKDFHIEVLPVFRLEDGFLYPDTRSDGSWKTTKPEAELRAMREFDAEKNNNLRRLCKMGRAWKNKHGQAMGGLLLDTLAHNFLKSNTTYDTRSYSSYDEMCRDFFKYMADQPKQVRYAALGSNQWVKVRKSFQRKAKLAYDLSVEAIAAAGQANEGAKWRKIFGTPFPLTAKVQKSARAGTFRDTEEFIEDLFPVDIKYSISLECTVSQDGFREHLLRFMIGQGMLLRPRKSLNFYIDSCDVPGNYELYWKVLNRGDEAERLDIIRGQIVKDTGHREKNETTNFRGDHVVEIFVVQNGVVVAKDRIHVPITPVATAAAA

SEQ ID NO: 5797 - protein, 432 aa, Brevundimonas nasdae
MSVADNFKSLLANLAVTNDETISLRYGEITSALNQEFRDTDSRTANSLQVGSYGRWTAIEGISDLDMIYIVPAGLWDQYNVAGGQSRLLTRTCAAIKARYPRTEVFVDSPVVRVLYKDFHIEVQPVFEEADGSFTYPHTKGGGTWKITKPRLEIAAMKDFDLQKNRNLRRLCKMARAWKNKHGVAMGGLLIDTLAHNFLKQTDAYDDRSYGAYDVMGRDFFGYLKDQPDQDHYGALGSGQRVAVKKKFQRKAGKAFDLCEAAIAAAGEVGEYRKWRKVFGRAYPAPEVVVAKAYVSEAGHQALNTEQFIEDQFRVDVRHHLRIDCKVTQDGFQPDWLRNILRKNWRLSPKKGLEFAVTESQVPDGAVYYWKVLNRGPEAVRRDCVRGQIAPDAGQRKKSESTHFRGDHVVECYAVLHGVVVAKDRIHVPIQE

SEQ ID NO: 5798 - protein, 431 aa, Brevundimonas sp.
MSISDSFKSFLSNIAVNNHETIELRYGEITCALNQEFRATQSKTANTLQVGSYGRWTAIKGISDLDMLYIMPVSAWNTYKDGGQYKLLSKVCEAIKARYPKTDVHVDGLVVRVLYADFHIEVQPVFEESDGSFTYPHTANGGSWKTTKPRLEMKAMTESEQQKNRNLRRLCKMARAWKNKHGVAMGGLLIDTLAHNFLKATSTYDETSYAAYDEMVRDFFAFLKDEPEKDYYAALGSGQRVKVKKKFQAKAKKAFELCETAIAARGQAGAHKKWRKVFGRAYPAPNTEIAKAFKSEGGHFARDTEQFIEDLFPVDIRYDLRIDCEVSQKGFRTIRLLEMLAKRFPLLVSKDLTFEIVRNDVPDGHIIYWKVLNRGPEAIRKDIVRGQIVPDTGQRQRSETTSFRGDHVVECYAVLNGVVVATDRIHVPIET

SEQ ID NO: 5799 - protein, 434 aa, Pseudomonas alcaliphila
MSTSTIFREFLGNLRITNHATIEDRYTEITRSLNKYFRDFDSTSNNLQVGSYGRWTAIEGVSDLDMLYIMPGSAWETYNKDGGQSALLSDARDAILKRYPATKITVDRLVVCVTFQNFNVEVQPVFRQGDGSFVYPDTYKGGAWKITKPKDEIEATKTVDDDQNGNLRRLCKMLRAWKNKHGIGIGGLLIDTLAHNFLTSTDAYANASFGSYDCMVRDFFEYAKNLPQQDRYAALGSRQHVKVKQKFQKPAKRAYELCVKAIEAQGEEYEGDRWKKIFGRSFPSTRTTTRSAMESLGSAYSFRNTEQFIEDLYPVDIRFPLSVDCDVEQDGFRERLLSELIQLGLPLRARKTLKFRVTHNGVPRPYSMKWKVLNTGDEAERRDCIRGNIVSDSGYESIQEATNFKGEHMVECYIIKDGVVVARSPIPVPISENT

SEQ ID NO: 5800 - protein, 434 aa, Pseudomonas stutzeri
MSTSTNFREFLSNLRITNDTTIEDRYAEITRSLNKYFRDLDSTSNNLQVGSYGRWTAIEGVSDLDMLYIMPDSAWETYNKDGGQSALLSHARDAVQKRYPTTKITVDRLVVCVTFQNFNVEVQPVFKQADGSFKYPDTYDGGAWKITKPKDEIEATKTVDDEQNGNLRRLCKMLRAWKNKHGIGIGGLLIDTLAHNFLTSTDDYATASSGSYDCMVRDFFAYAKDLPQQDRYAALGSRQHVKVKQKFQKPAKRAYELCVKAINAQGEEYEGDRWKKVFGRSFPSTRTTKRSAMESLGSAYSFRNTEQFIEDLYPVDIRFPLSVDCDVEQDGFRERLLSELIQLGLPLRARKTLKFKVTYNGVPKPYSVKWKVLNTGEGAEKRDCIRGSITSDSGREAIQETTSFKGEHMVECYIIKDGVVVARSPIPVPISENI

SEQ ID NO: 5801 - protein, 435 aa, Pseudomonas psychrotolerans
MSVAVIFKDFLSNLRITNHVTIEDRYAGITRSLNKYFRRLDSAANNLQVGSYGRWTAIKGVSDLDMLYIMPDSDWHRYNKEGGQSKLLADTKAAIQERYSMTTITVDRLVVCVKFQNFNVEVQPVFKQDDGSFKYPDTYNGGSWKVTKPKDEIKATSNVDVDQNGNLRRLCKMLRAWKNKHGIGIGGLLIDTLAHNFLTQTDDYADKSFASYDCMVRDFFYYASSLPQQERYAALGSRQHVKVRQKFQKPARRAYELCLKAIEAAGKENEGERWKKVFGRDFPTTRTAARAAMESMAKSLYTFRDTEEFIEDLAPIDIRYPLVLDCDVEQKGFREYLLSELISLGLPLQARKTLKFKITLNNVPKPYTVKWKVLNIGQEAERRDCVRGYITDDRGYETIQESTSFKGDHSVECYILKDGVVVARSEITVPISENI

SEQ ID NO: 5802 - protein, 435 aa, Pseudomonas sp.
MSVAVIFKDFLSNLRITNHVTIEDRYAGITRSLNKYFRRLDSAANNLQVGSYGRWTAIKGVSDLDMLYIMPDSDWHRYNKEGGQSKLLADTKAAIQERYSMTTITVDRLVVCVKFQNFNVEVQPVFKQDDGSFKYPDTYNGGSWKVTKPKDEIKATSNVDVDQNGNLRRLCKMLRAWKNKHGIGIGGLLIDTLAHNFLTQTDDYADKSFASYDCMVRDFFYYASSLPQQERYAALGSRQHVKVKQKFQKPARRAYELCLKAIEAAGKENEGERWKKVFGRDFPTTRTAARAAMESMAKSHYTFRDTEEFIEDLAPIDIRYPLVLDCDVEQKGFREYLLSELISLGLPLQARKTLKFKITLNNVPKPYTVKWKVLNTGQEAERRDCVRGYITDDLGYETIQESTSFKGDHSVECYILKDGVVVARSEITVPISENI

SEQ ID NO: 5803 - protein, 435 aa, Pseudomonas antarctica
MSVAVIFKDFVSDLRITNHVTIEDRYASITRSLNKYFRTLDSTANNLQVGSYGRWTAIKGVSDLDMLYIMPGSAWDRYNKEGGQSKLLSDTKAAIQERYSTTTITVDRLVVCVKFQNFNVEVQPVFKQDDGSFKYPDTYNGGSWKITKPKDEIQATGDVDDDQNGNLRRLCKMLRAWKNKHGIGIGGLLIDTLAHNFLTQTDDYADKSFASYDCMVRDFFYYASNLPQQERYAALGSRQHVKVKQKFQKPAKRAYELSLKAIEAAGKENEGERWKKVFGPDFPTTRTAARAGMESLAKSFYTFRDTEEFIEDLAPIDVRYPLVLDCDVEQKGFRERLLSELISLGLPLQARKTLKFKIGRNDVPEPYTVKWKVLNIGQEAEKRDCIRGYIIADQGHETIQESTSFKGDHSVECYILKDGVVVARSEITVPISENI

SEQ ID NO: 5804 - protein, 435 aa, Pseudomonas syringae
MSVAVIFRDFLSNLRITNHITIEDRYAGITRSLNKYFRTLDSTANNLQVGSYGRWTAIKGVSDLDMLYIMPSSDWSRYNKEGGQSKLLSDTKAAIQERYSTTAVTVDRLVVCVKFQNFNVEVQPVFKQDDGSFKYPDTYNGGSWKVTKPKEEITATSAVDDDQNGNLRRLCKMLRAWKNKHGVGIGGLLIDTLAHNFLTQTDRYADKSFASYDCMVRDFFYYASNLPQQERYAALGSRQHVKVKQKFQKPAKRAYELSLKAIEAAGKDSEGERWKKIFGRDFPATRTTLRASMESLDKSIYTFRDTEEFIEDLAPIDVRYPLVLDCDVEQKGFRERLLSELISLGLPLQARKTLKFKIARNDVPEPYTVKWKVLNIGQEAEKRDCIRGYITADQGHETIQESTSFKGDHSVECYILKDGVVVARSEITVPISESI

SEQ ID NO: 5805 - protein, 435 aa, Pseudomonas viridiflava
MSTADNFKSFLSNLRIDNHRTIENRYRGVTRSLNKHFRKSQSKSYNLQVGSYGRWTAIKGVSDLDMLYIVPDSDWDKYNKEGGQAKLLADTKAAIQDRYSRTTIKVDRSVVCIKFKKFQVEVQPVFKQTDGSFRFPDTYRGGSWKNTKPKDEIRAASEIDLAQNGNFRKLCKMLRAWKNKNGLGIGGLLIDTLAYNFLSEKNEYATKSFGSYDCMVRDFFLYASQLKYQERYSALGSRQHVKVKQNFQRPAKKSYAQALKAIEAAGQKNEGEQWQKLFGPVFPATKVMTRSGMESINSSSNRFDDTEEFIENFAPVDIRYPLVIDCDVKQNGFRETLLSTLISSGFPLQARKTLNFKIISNDIPPPYSVKWKVLNIGYEAEKRNCIRGFIIDDSGHESIEEHTSFKGDHTVECYVIKDEIVVARSEVIVPISETL

SEQ ID NO: 5806 - protein, 437 aa, Pseudomonas putida
MSTATNFRTFFDNIKITNHATIETRYEEITLSLNKRFRDLESRTRYNLQVGSYGRWTAIKGISDLDMLYIMPGSAWQTYNKSGGQFNLLTDVKNALLKRYPNTNIYVDRLVVCVTFASFHVEVQPVFEQADGSFKYPDTYNGGSWKITKPREEIEATRTTNDENNGNLRYLCKMIRAWKNKHGIGIGGLLIDTLAHNFLKSTTLYADKSFSWHDWMIRDFFKYASELPVQDRWAALGSRQHVKVKQKFQKSAKKAHELCVKAIDASGEEYEGDRWKKVLGREFPSTRTLLAKAGMESLITNSRSFRDTEQQIEDQAPVDIRYPLNIDCEVIQNGFRERLLSELISLGMPLRARKNLKFHITKNGVPEPYDIKWKVLNIGEEAERRDCIRGQIFDDYGRQQVNESTTFKGDHLVECYILKNGVVVARDQVLVPISETV

SEQ ID NO: 5807 - protein, 437 aa, Pseudomonas sp.
MSTATNFKTFFDNIKITNHETIETRYEEITLSLNKRFRDLESRTRYNLQVGSYGRWTAIKGISDLDMLYIMPGSAWQTYNKSGGQFSLLTDVKNSLLKRYPNTNIYVDRLVVCVTFASFHVEVQPVFEQADGSFKYPDTYNGGSWKITKPREEIEATKTTNDENNRNLRYLCKMIRAWKNKHGIGIGGLLIDTLAHNFLKSTTLYADKSFSWHDCMIRDFFGYASKLPNQDRWAALGSRQHVKVKQKFQKSAGKAHDLCVKAIEATGKEYEGDRWKKVFGPEFPSTRVFLAKAGMESLITNTRSFRDTEQQIEDQVPVDIRYPLTIDCEVIQNGFRERLLSELIAMGMPLRARKNLKFHITKNSVPEPYDIKWKVLNIGEEAEKRDCVRGQIFNDYGRHEVSESTTFKGDHLVECYVLKNGVVVARDQVLVPISETV

SEQ ID NO: 5808 - protein, 425 aa, Vibrio sp.
MSVSEDFKQFLVNIRVDNSESISERYGQITKALNKKFRNTESTTSNTLQVGSYGRFTGIKGISDLDMLYIMPGCKWETYKDKQSQLLKDTKEAILARYPTTDVKVDSLVVVVKYKNFKVEVQSVFEQDDGSFKYPYTHNGGSWRFTKPKDEMKAMKELNETKNKNLRPLCKMARAWKNKHGVAMGGLLIDTLAHNFLKGTTDYDNTGPLYYDEMCRDFFEYLGNLPKQERWGALGSNQHVKVKKNFQRAAKKTFDLCVEAIDDDNNNERWRKVFGRGYPQNAENLKAIAENRQTWRDTEEFIADKYPVDIRYHMAIDCDVSQNGYREYSLSEMLRLFIPLRARKSLSFSVSEIEVPQPYLLKWKVLNRGPEAERRDCIRGQISDDTGYGNRSESTSFNGEHSVECYAIKDGVVVARSEITVPISN

SEQ ID NO: 5809 - protein, 425 aa, Vibrio cholerae
MSVSEDFKQFLVNIRVDNSESISDRYGQITKALNKKFRNTESTTANTLQVGSYGRFTGIKGISDLDMLYIMPGCKWETYKDKQSQLLKDTKDAILARYPTTDVKVDSLVVVVKYQNFKVEVQPVFEQDDGSFKYPYTHNGGSWRITKPKDEINAMKEVNEAKNKNLRPLCKMARAWKNEHGVAMGGLLIDTLAHNFLKGTTDYDKTGPLYYDEMCRDFFEYLGNLPKQERWSALGSNQHVKVKKNFQRAAKKAFELCVEAINDGNNNERWRKVFGRGYPQSAENFKAIAENRQTWRDTEEFIADKYSVDIRYHMAIDCDVSQNGYREYSLSEMLRFSIPLRARKSLFFSVSEIEVPQPYSLKWKVLNRGPEAERRDCIRGQILDDTGYGNRSESTSFNGEHSVECYAIKDGVVVARSEITVPISN

SEQ ID NO: 5810 - protein, 425 aa, Vibrio cholerae
MSVSEDFKQFLVNIRVDNSESISDRYGQITKALNKKFRNTESTTANTLQVGSYGRFTGIKGISDLDMLYIMPGCKWETYKDKQSQLLKDTKDAILARYPTTDVKVDSLVVVVKYQNFKVEVQPVFEQDDGSFKYPYTHNGGSWRITKPKDEINAMKEVNEAKNKNLRPLCKMARAWKNEHGVAMGGLLIDTLAHNFLKGTTDYDKTGPLYYDEMCRDFFEYLGNLPKQERWSALGSNQHVKVKKNFQRAAKKAFELCVEAINDGNNNERWRKVFGRGYPQSAENFKAIAENRQTWRDTEEFIADKYSVDIRYHMAIDCDVSPNGYREYSLSEMLRFSIPLRARKSLFFSVSEIEVPQPYSLKWKVLNRGPEAERRDCIRGQILDDTGYGNRSESTSFNGEHSVECYAIKDGVVVARSEITVPISN

SEQ ID NO: 5811 - protein, 425 aa, Salinivibrio sp.
MSVSEDFKQFLVNIRVDNSETISERYGQITKALNKKFRNTESTTANTLQVGSYGRFTGIKGISDLDMLYIMPGCKWETYKDKQSQLLKDTKDAILARYPTTNVKVDSLVVVVKYQNFKVEVQPVFEQDDGSFKYPYTYNGGSWRITKPKDEIKAMKEVNEAKNKNLRPLCKMARAWKNKHGVAMGGLLIDTLAHNFLKGTTDYDNTGPFYYDEMCRDFFEYLGNLPKQERWSALGSNQHVKVKKNFQRAAKKAFELCVEAIDDDNNNERWRKVFGRGYPQSAENLEAIAENRQTWRDTEEFIADKYPVDIRYHMAIDCDVSQNGYREYSLSEMLRFSIPLRARKSLSFSVSEIEVPQPYSLKWKVLNRGPEAERRDCIRGQILDDKGYGNRSESTSFNGEHSVECYAIKDGVVVARSEITVPISN

SEQ ID NO: 5812 - protein, 425 aa, Aliivibrio fischeri
MSVSEDFKQFLVNIRVDNSESISERYGQITKALNKKFRNTESTTVNTLQVGSYGRFTGIKGISDLDMLYIMPSCKWEAYKDKQSQLLKDTKDAILARYPKTDVKVDSLVVVVKYQNFKVEVQPVFEQGDGSFKYPYTHNGGSWRITKPKDEIKAMKDVNEAKNKNLRPLCKMARAWKNKHGVAMGGLLIDTLAHNFLKGTTDYDNTGPFYYDEMCRDFFEYLGDLPKQERWSALGSNQHVKVKKNFQRAAKKAFELCVEAIDDDNNNERWRKVFGRGYPQSTGNLEAIAENRQIWRDTEEFIADKYPVDIRYYMAIDCDVSQNGYREYSLSEMLRLFIPLRAKKSLSFSVSEIEVPQPYSLKWKVLNRGQEAERRDCIRGQILDDAGYGNRSELTIFNGEHSVECYAIKDGVVVARSEIIVPISN

SEQ ID NO: 5813 - protein, 437 aa, Grimontia indica
MKVVELLACRCDVSVSEDFKQFLVNIRVDNSASISERYGQITKALNKQFRNTDSTTANTLQVGSYGRFTGIKGISDLDMLYIMPSSKWETYKDKQSQLLKDTKDAILARYPTTDVTVSSLVVVVKYKNFMVEVQPVFEQEDGSFKYPYTHKGGSWRFTKPKDEMKAMKEVNDAKNKNLRPLCKMARAWKNKHGVAMGGLLIDTLAHNFLKSTTDYDNRGPLYYDEMCRDFFEYLSNLPKQDRWNALGSNQHVKVKKNFQRAAKKAFALCVEAIDDDNNNERWRKVFGRGYPQSAKNLAAIAENRQTWLNTEEFIADKYPVDIRYHMAIDCDVSQNGYREYSLSEMLRLFIPLRAQKSLSFSVSEIEVPQPYSLKWKVLNRGPEAERRDCIRGQILDDAGYGNRSESTTFNGEHSVECYAIKDGVVVARSEITVPISN

SEQ ID NO: 5814 - protein, 425 aa, Grimontia indica
MSVSEDFKQFLVNIRVDNSASISERYGQITKALNKQFRNTDSTTANTLQVGSYGRFTGIKGISDLDMLYIMPSSKWETYKDKQSQLLKDTKDAILARYPTTDVTVSSLVVVVKYKNFMVEVQPVFEQEDGSFKYPYTHKGGSWRFTKPKDEMKAMKEVNDAKNKNLRPLCKMARAWKNKHGVAMGGLLIDTLAHNFLKSTTDYDNRGPLYYDEMCRDFFEYLSNLPKQDRWNALGSNQHVKVKKNFQRAAKKAFALCVEAIDDDNNNERWRKVFGRGYPQSAKNLAAIAENRQTWLNTEEFIADKYPVDIRYHMAIDCDVSQNGYREYSLSEMLRLFIPLRAQKSLSFSVSEIEVPQPYSLKWKVLNRGPEAERRDCIRGQILDDAGYGNRSESTTFNGEHSVECYAIKDGVVVARSEITVPISN

SEQ ID NO: 5815 - protein, 424 aa, Aliivibrio salmonicida
MSVSEDFKQFLVNIRIDNSGNISNRYGQITKALNKQFRNTESTIANTLQVGSYGRYTGIKGISDLDMLYIMPDGKWDTYKDKQSQLLKDTKDAILSRYPTTDVKVDSLVVVVSYQNFKVEVQPVFEQDDGSFKYPYTHKDGSWRITKPKDEIKALKEVNEAKNYNLRPLCKMARAWKNKHGVAMGGLLIDTLAHNFLNNSDAYDNKGPHYYDEMCRDFFEYLSNLPKQERWNALGSNQHVKVKKNFQQAAKKAFDLCVEAINDSNNEKWRKIFGRGYPQSVENLAAIVENRQTWLDTEEFITDKYPVDIRYHMAIDCDVSQNGYREYSLSYMLRNFVPLRANKSLFFSVSEIEVPKPYLLKWKVVNRGPEAERMDCIRGQILDDSGYGNRSESTNFNGEHSVECYVIKDGVVVARSEITVPIAR

SEQ ID NO: 5816 - protein, 424 aa, Vibrio vulnificus
MSVSEDFKQFLKNIRVSKAEIIGNRYDRITKALNKQFRNSLSKKDNTLQVGSYGRYTGIKGISDLDMLYIMPDSKWATYEKDPGQLLKDTKSAILATFPRTKVKVDTLVVVVQYKNFKVEVQPVFKEEDGSFKYPYTRGGKPWRITKPKDEMKAMTEVNEAKNENLRPLCKMARAWKNKHGVAMGGLLIDTLAHNFLNGTSVYDNKGPSHYDEMCRDFFKYLSELPKQDRWNALGSNQHVKVKKNFQRAAKKAYELCVEAIKDNNNEKWRKVFGRCYPQSAENLAAIVKSRQTWLDTEEFIDDKYHIDIRYHMTIDCDVSQNGYREYSLSHMLRHFIPLRAKKSLSFRVSEIDVPEPFLLKWKVLNRGSEAERRDCIRGQILDDAGYGNHSESTTFSGEHSVECYAIKDGVVVARSEITVPISN

SEQ ID NO: 5817 - protein, 424 aa, Aeromonas hydrophila
MSVSNDFKAFLEKIKVDNADVITLRYAEITRVLNKRFRNSESTEENSLQVGSYGRYTAIKGISDLDMIYIMPDSQRSYYQSKQSQLLSDTKDAILARYPRTDVKVDRLVVVVTYTNFKFEVQPVFEREDGGFDYPDTSDGGSWKVTRPRSEIRTINEVNNEKSGNLKLLCKMARAWKNKNGIVMGGLLIDTLAHNFMKSTSDYDDKSYFYYGVMCHDFFKFLSNLPEREWFAALGSKQRVLVKKKFQKRAKNTHQLCVSAIQNNNSNNIWRQVFGSAYPRADVILESTNKSKHVWSDTEEFIDEILPEDIRYELNVECEVSQKGFRKKTLSDMIRYGIPLKTKKSLLFKVISTDVPAPYIIKWKVLNQGEEAERRNLIRGQILDDKGFGNHEENTEFLGEHVVECYAIKNGVVVAKSIVNVPIR

SEQ ID NO: 5818 - protein, 396 aa, Vibrio vulnificus
MISHITSNLDLTETQLSQLKTAYRAIGSYLANQGGKLAECHIYAQGSVGIGTSVKPIDEDSDMDIDLVLHLPSQHYPTTTDEANELLFNLIRVLKDSQRYGDKIENMPKRRCVTLQYGGIEGQGFHMDITPSMPEDMDSPNHKSKVRVADIKDANSPSHPYGYRKWFRSACSKEIRWNRKSNYRSNNDIHAGTVEPLPGQGRKTVLQIVVQLLKRHRDMWKQNKQNAYGDCAPISIIITTLAGLAYEKCSNSNKEYHNPFDLMLDVLEEMPNFISHQYQSDGTLKYTIRNPALPTENFADKWHEKPMLPQAFKAWYTQVTEDLAKLLELDQGLDKTIERSREMFGSQAARGIQAKLADTLTERRAKNRAVVSSIGLGVSNAATATPVPKHNFYGDV

SEQ ID NO: 5819 - protein, 355 aa, Vibrio cholerae
MPNPPEYEHLKNQVRILSLNGGGARGLFTISLLAEIERIIEEKQGINGFKVGDYFDLITGTSIGGILALGLAYGKSARELEDVFRKQAGYIFPEQKYPRFFPVFRRRYRLARGPLYDSKPLAKTIASMVGEESTFNDLKCRVLIPTVNLSTGKPQFFKTPHNPEFHRDGRIKLIDAALATSAAPTYFAPHYCVDLDSYFADGGLVANNPSFIGLHEVFRDMATDFPEAKVSDVKILNVGTLGEEYSLSPSSLAGKSGYLGLWGMGERLVLSAMAANQELHKAMLLREFATHDAIGNFVRLDNNIPHEAASDITLDNASASSLSNLASRGRQLATEEFTKNKALADFFKVPARKFK

SEQ ID NO: 5820 - DNA, 1068 bp, Vibrio cholerae
atgccaaatccacctgaatatgaacaccttaaaaaccaagtccgaattcttagtttgaatggcggtggtgcaagaggcttgtttactatcagcttgttagctgaaatagagcgaatcatcgaggaaaaacaaggtattaacggttttaaagttggagattattttgacctgattacaggtacttctattggtggaattctggctttgggtttggcttatggaaagagcgccagagaactggaagatgtctttagaaaacaagctgggtatattttcccagagcagaaatacccacgatttttcccagtttttcgcagacggtatcgactggccagaggtccactttatgatagtaagccattggctaaaacgatagccagtatggtaggagaagagagcacttttaatgatctgaagtgtcgagttctaattcctacagttaatctttctacaggtaaacctcagttcttcaaaacgccccacaatcctgagtttcatagggatggtcgtataaaactaatagatgcagccttagctacctcagctgctcccacatattttgctcctcattactgtgtagacttagattcgtactttgcagatgggggattggttgctaacaatccaagttttattggcttgcatgaagtctttcgcgatatggcaacagactttcctgaagcaaaggttagcgatgtaaagatactaaacgtagggacattgggagaagagtacagtcttagcccttctagtttggccgggaagagtggatacctaggattatggggaatgggtgagaggttagttctcagcgccatggcagcgaaccaagaactccataaagcaatgttattgagagagtttgcgacacatgatgctataggaaatttcgtgcgcttggataacaacatacctcatgaagccgctagtgatatcactttggacaacgcttctgcaagctcgctcagtaatttagctagccgcggtaggcagttagctactgaagagttcactaaaaacaaagcattggcagattttttcaaagtacctgcccgcaaatttaagtaa

SEQ ID NO: 5821 - protein, 357 aa, Escherichia coli
MSELHVVNDHGVRLLCLNGGGARGMFTISVLAEIERILASRHPDQEIRIGDYFDLIAGTSIGGILALGLAKGKSARELECVFLDKANDIFPPRWWLFNLLKSLVSPIYSSKPLRQTIETMIGGETTFNDLARRVMVPAVNLSTGKPQFFKTPHNPDFTRDGALKLIDAALATSAAPTFFAPHHCEDLGSYFADGGLVANNPSYIGFLEVFRDMKSDFPDVAHKDIHILNIGTTGEEYSLSPRLLSKKWWNGYCRLWGVGKKLVLTTMAANQHLHKNMLLRELTLHGASDNYTSLDEVIPNEAASDITLDNATKSSIENLRARGRQLATVQFAQNQKLKSFFTTPAKPFKRAIAQEKL

SEQ ID NO: 5822 - DNA, 1074 bp, Escherichia coli
atgtctgaattgcatgtagtcaatgaccatggagtacggctactctgcctaaatggtggtggggccagagggatgtttacaatcagtgtgcttgctgagattgagaggatacttgcctctaggcaccctgaccaagaaatcagaattggcgattactttgacctcatcgcagggacatcgataggtgggatcttggctctcggccttgctaaaggcaagagtgctcgcgagttggaatgtgttttcttagataaagcgaatgatatttttccaccaagatggtggctattcaatctccttaaatcacttgtttctcccatttatagtagtaaaccacttcgacaaacaattgaaacgatgatcggtggtgagactacctttaatgacctggcccggagagtaatggtcccggcagtcaatctttcaacaggaaaacctcagttcttcaagacaccacataacccagattttacccgcgacggtgcacttaaattgattgatgccgcactcgcaacctccgctgcaccgacgttctttgcaccacaccattgtgaagaccttggttcttattttgctgatggaggtctggtcgccaacaaccccagttatatcggatttttggaagttttcagggacatgaagtctgattttcctgatgttgctcataaagacatacacatacttaatatcggtactaccggggaagagtattcacttagcccaaggctgctgagcaaaaaatggtggaatggctactgccgactttggggcgtaggtaaaaaactggtccttacaaccatggcggctaaccaacatctccataaaaatatgctcctgcgcgagcttacgctccatggtgcctccgataactacaccagtctggatgaagtgatccctaatgaagcagccagcgacatcactctggataatgccacgaagagttccattgaaaacctgcgcgcaaggggaagacaactcgctactgtgcagttcgctcagaaccagaagcttaagagctttttcactacacctgcaaaaccctttaagcgcgcaatcgcgcaggagaaactctga

SEQ ID NO: 5823 - protein, 333 aa, Pseudomonas aeruginosa
MTGIPTYHVLALSGGGYRGLYTATVLAELETVLGRPIASHFDLICGTSAGGMLALGLAAEIPAYELKALFEEQGSRIFGCRSLPRRLLGFWLTAKHDSAGLKEVLTERFQGTTIGDLKHRVLVPAVNYSTGRGQFFKTPHHPSFELDHRMKVVDVALATAAAPVYFPLARNDRGVFADGGLVGNAPGLFGLHEVKTFLAPKQDALVRVLAIGTMTIGATVRGGASLDRGFGKWRGGLFDLVISAQESSVDHMLRQALGNNYFQIDDKATPDQSKDVKALDRVSIGATNTLKDRGNHAAQRALGDPLFQPFRAHQADAPIFYHGPNKNVPEAAC

SEQ ID NO: 5824 - DNA, 1002 bp, Pseudomonas aeruginosa
atgacgggcatccctacctaccatgtgctcgccctgtcagggggcggttatcgcggcctgtacaccgccacggttctcgccgaactcgaaaccgtgctgggccgtccgatcgcttcgcactttgatctgatttgcggcacatcggcaggagggatgctggctttggggctggctgcggaaattccggcctacgaactcaaggcactgtttgaagaacagggcagccgcatctttggctgccgcagcctgccgcggcggcttctgggattctggctgactgcaaagcatgactcagcgggattgaaagaggtactgaccgagcgcttccaagggaccacgataggtgacctgaagcatcgtgttcttgtgccggcagtcaactactcgacgggacgcgggcagttcttcaagacaccgcaccatccgtcctttgagctggatcaccgcatgaaggtcgttgatgtggcgttggcgacagccgccgcgcccgtctactttcctctggcgcgcaacgaccgcggtgtcttcgcggatggggggctggtgggcaacgccccgggcctgttcgggttgcacgaagtcaagacgttcctggcgccgaagcaggatgcgctggttcgggtcctcgccatcggcacgatgaccatcggtgcgaccgttcgtggcggcgccagcctcgaccgcggattcggcaagtggcgcgggggactcttcgatctcgtgatctccgcccaggagtcgtcggtggaccacatgctgcggcaggcgttgggcaacaactacttccagatcgacgacaaggcgacgccggatcaaagcaaggacgtgaaggcgctggatcgggtttccattggcgccacgaatacgctcaaggatcgcggcaaccacgcggcgcagcgtgcgctcggcgatcctcttttccaaccatttcgagcgcaccaggccgacgctcccatcttctatcacggccccaacaagaatgttccggaggccgcatgctga

SEQ ID NO: 5825 - DNA, 1002 bp, Artificial Sequence
  Description of Artificial Sequence: Synthetic polynucleotide
atgaccgggattcctacttaccacgttttagctttgtccggaggcggttaccgtggcctgtatactgcaacggtactggccgagctggaaacagtattaggtcgtccgatcgccagccacttcgatttgatttgtggaacaagcgctggaggaatgctggcccttggcttagccgccgaaattccagcatacgagcttaaagcactttttgaggaacaaggtagtcgcatctttggttgccgctcgcttcctcgtcgccttctgggtttctggctgaccgcaaagcacgattctgcaggcttgaaagaagtacttactgaacgtttccaaggcacaaccattggcgacttgaaacatcgcgtgctggtgcctgcggtcaactacagtactgggcgcgggcagttcttcaaaaccccacatcatcccagcttcgaacttgatcaccgtatgaaagttgtcgatgtggcactggcaactgccgccgcgcctgtgtacttcccgttggcacgcaatgaccgtggggtttttgctgatgggggtttggttggtaatgcaccaggtttgtttggcttgcatgaagttaagaccttccttgcgccaaagcaggatgcgctggtccgtgtacttgctatcggcacaatgactattggagccactgtgcgcggtggtgcctctttagatcgcggctttggaaaatggcgcggtggtctgtttgaccttgtcatctccgcccaagagtctagcgtagatcacatgctgcgtcaggcacttgggaacaattatttccaaatcgatgacaaggccacacctgatcagtctaaggatgtaaaagcgcttgatcgtgtgtcaatcggggccacaaacacgcttaaagatcgtgggaatcatgctgcccagcgtgcattaggcgatccgctgtttcagccatttcgcgctcaccaggcggatgccccgatcttctaccacggccccaataaaaacgtcccggaagctgcgtgttga

SEQ ID NO: 5826 - protein, 328 aa, Xanthomonas citri
MDHTPPLHVLALSGGGYRGLYTATVLAELEQVLGRPIAQHFDLICGTSAGGMLALGLANEIPASELKDLFEKHGARIFGSRSLARRLLGFWLIAKHNPDGLREVLAERFGETTLGDLKHPVLIPAVNYSTGKGQFFKTPHHPSFELDHRLKVMDVALATAAAPVYFPLARNERGVFADGGLVGNAPGLFGLHEARHFLATNPGVQVRVLSIGTMTVGSTVRGNANLDRGFGKWRGGLFDLVISAQESSVHHLLGHALGADYYKIDDQATPDQSKDVKALDRVSIAATNTLKDRGNHAAQRAIGDLAFRPFRDHQAPPPRFFHGSNKNA

SEQ ID NO: 5827 - DNA, 987 bp, Xanthomonas citri
atggaccataccccgcccctccacgtgctggccctttcgggcggcggctaccgtggcctgtataccgccacggtcctggccgaactggaacaggtgctcgggcgcccgattgcccaacattttgatctgatctgcggcacgtcggcgggcgggatgttggccttagggctggccaacgagatccccgcgagcgagctgaaagacctttttgaaaagcacggcgcgcgcatcttcggctctcgcagcttggcaaggcggctgcttggcttctggcttatcgccaagcacaaccctgacgggctgcgggaagttctggcagaacgcttcggcgagaccacgcttggcgacctcaagcaccccgtgctgatccctgctgtgaactactccaccggcaaaggacagttctttaaaacgccgcatcaccccagcttcgaactggaccatcgccttaaagtgatggatgtggcattagcaactgcagcagcgccggtctacttcccgctcgcacgcaatgagcgaggcgtgtttgctgatggtggcttggttggcaacgcaccagggctgtttggtcttcatgaggcacgccacttcctcgctaccaatccaggcgttcaagttcgggtgctttcgattggcaccatgaccgtaggctccaccgtccggggaaacgctaatctggatcgcggcttcggcaaatggcgtggcgggctgttcgatctggtgatctcagcccaagagtcgtcagtccatcacttgctggggcacgccttgggcgcggactactacaagatcgatgaccaagccactccggaccagagcaaggatgtcaaagctttggatcgagtctcaattgctgcgacaaacacgctgaaagatcgaggcaaccacgcagcgcagcgcgccattggggatctggcattccggccattccgcgatcaccaagcccccccgccccgcttcttccacggctccaacaaaaacgcttag

SEQ ID NO: 5828 - DNA, 987 bp, Artificial Sequence
  Description of Artificial Sequence: Synthetic polynucleotide
atggatcatacgcccccactgcatgttttggcgttgagtggtggtgggtaccgcggattgtacacggcaactgtacttgctgaattagagcaagtactgggccgtcccatcgctcagcacttcgacttgatttgtggcacatcagcaggaggtatgcttgcactgggattagccaacgagatccccgcttctgagttaaaggatttgtttgagaaacatggggcgcgtatctttggctcccgttcattggctcgccgcctgttagggttttggttgattgcgaagcacaaccccgatggcttacgcgaggttttggccgaacgtttcggagaaaccacgttaggggatttaaagcacccagttctgatccctgctgttaattatagcaccggaaagggccaattctttaagaccccgcaccacccgtcctttgaattagatcaccgcttgaaggtgatggacgtagcgcttgcaactgccgcagcccccgtttactttcccttagctcgcaatgaacgtggagtctttgccgatggtggtctggtagggaacgcccctggtttatttggtttgcatgaggctcgccactttttagccactaaccccggggtacaagttcgcgtcctgtctatcggaaccatgacggtaggtagtaccgtccgtggaaacgcaaatttggaccgcggctttgggaagtggcgtgggggcctttttgatcttgtgatctcggcccaggaatcctcggtccaccatttgttagggcacgctttgggtgctgattactataaaatcgacgatcaagcaacgccggaccagagcaaagatgtgaaagctctggaccgtgttagtatcgctgcgactaacactctgaaagatcgcggcaaccatgccgcccaacgcgccattggcgatttggctttccgccctttccgtgaccatcaggcacctccaccccgtttcttccatgggtcgaataagaacgcgtga

SEQ ID NO: 5829 - protein, 377 aa, Desulfotomaculum alkaliphilum
LEKIQVLLFTGILVIGIILVFSSFSRNKKEEGLSNIIIMAGLELIISSFGTIEDKIVSIVSLVLVNTEIEVLRIFENNSDTNITQLGVGLLLLVLGFYLKRYIKNKIYILNINGVFDQRIENHRNDLKLSAFEFKEREIDFIWLYKKGMSKHIARDIIELIQEKIKSFRNESKEYKRGYTGISPIPFIMYAGTLLKKDEFHEYFEYDKMETHKYYRLKKIGRMKKNKYTVLGPKTNISDVNKYANEIVLAISITSEIKETDLEQFSGKEIVHLLVDKLGDNTIRYKEQLREYTRVIYDTIELLSKSIDKLTKIHLIYSGQSCLALELGKIIDDNRMTQIINYHYVRESSCRYPWGIVLNGKNKGEYVELECGGGSIV

SEQ ID NO: 5830 - DNA, 1134 bp, Desulfotomaculum alkaliphilum
ttggaaaagatacaagttcttttatttacaggtatattggttattggcataatccttgttttcagtagtttttcaaggaataaaaaagaggaaggactatcaaatatcataattatggcgggcttagaattaataataagctcatttggaacaattgaagataaaatagtatcaatagttagccttgttttagttaatacagaaattgaggtattaaggatatttgaaaataattcagacactaatattactcaacttggggtaggcttattgttgttagtattaggtttttatctaaagcgctatattaagaataaaatatacatattaaatattaatggtgtctttgaccaaaggatagaaaatcatcgcaatgatttgaagttaagtgcctttgaatttaaagagagagaaatagattttatttggctgtataaaaaaggcatgtcaaaacacatagctcgagatattattgaactaatacaagagaaaataaaatcattcagaaacgaaagcaaagagtataaacgtggttatacaggaatatcaccaattccatttattatgtatgcaggaacacttcttaagaaagatgagtttcatgaatattttgaatacgacaaaatggaaactcacaaatattataggctaaaaaaaattggacggatgaaaaaaaacaaatacactgttctgggcccaaaaacaaatataagcgatgttaataagtatgcaaatgaaattgtcttagctatttctattacttcggaaattaaagagacggatttagaacagtttagcggtaaagaaattgtacatttgcttgttgataaattaggtgataatactataaggtataaagagcaactaagggaatatacaagggttatttatgacacaattgaactactaagcaaatctattgataaattaactaaaatacatctcatatattctggacagagttgcttagctttagaattaggaaaaattattgacgataatagaatgacacaaattataaattaccattatgtacgtgaatcatcatgtagatacccttggggaatagtcttaaatgggaaaaacaagggtgagtatgtagaattagaatgtgggggtggctctattgtttga

SEQ ID NO: 5831 - DNA, 1131 bp, Artificial Sequence
  Description of Artificial Sequence: Synthetic polynucleotide
atggagaagattcaggtgttgctgtttacgggcatcctggtaattggtatcatcttagtattctcctcattctcacgcaacaaaaaagaggagggcctttctaacatcattatcatggccggattggagttgattatctctagcttcggaaccattgaagataaaatcgtgtccatcgtaagcttagtcttagtcaatacagaaattgaagtgctgcgtatttttgaaaacaattccgacacaaatatcactcaattaggggttggattattgttacttgtgttaggcttctacctgaaacgttatatcaaaaataaaatttatattcttaatattaacggcgtgtttgaccagcgtattgagaaccaccgcaatgacctgaagttgagcgccttcgagttcaaggaacgcgaaatcgacttcatctggctttataaaaaaggaatgtcgaaacacatcgcacgcgatatcatcgaactgatccaagaaaagattaaaagttttcgcaatgagtcaaaagaatataaacgtgggtacactggcatcagtcctatcccattcattatgtatgctggaacccttcttaaaaaagacgaatttcacgaatattttgaatacgacaagatggaaacgcacaaatactaccgcctgaagaagatcggacgcatgaaaaagaacaaatataccgttttgggtcctaagacaaacatttcggatgtgaataagtacgctaatgagatcgttcttgcaatttcaatcacttcagaaatcaaagagaccgatttagagcaattcagcggtaaggagatcgtacaccttcttgtagacaagctgggtgacaatacaattcgctataaagagcaactgcgtgaatatactcgtgtaatctatgacacgatcgaacttcttagcaagagcattgacaagttaactaagatccacttaatttattcgggacagagctgtttagctttggaattaggcaaaattatcgacgacaatcgcatgacccagatcattaattatcattacgtgcgtgagtctagttgccgctacccgtggggaatcgtccttaatggtaagaacaagggtgaatacgtagagttagagtgcgggggaggatcaatcgtc

SEQ ID NO: 5832 - protein, 351 aa, Bacteroides fragilis
MQDNISNFKILSIDGGGIRGVIPAKILCDLEEEAIKKDGPAARLCDYFDLVCGTSTGGIIAIGIALGMTAKEILNLYMKNATKIFPKKNIITSFTKNTPFYEKKPLEELLQECYGGCTRNRDTRIQHCRTRLCIPTYDLDKGEVHVFKTDHLPQYHRDCHVPVVDVALATAAAPVYFSPHTFQYEDIGTTNTNTFTNNIDGGVLANNPALIGLAEAQYCIGHPLENIEMLSLGTGTVNLKENRTGKKMGVRYWIHPKSEQGLRIYEVMSSAQSLFIDNMMKMIFKGAGHGGKQRFKYVRAQKALDTNLPLDTTNKHSLDRLLNIGQELYKEHGELMKPFLDNKIIPYEHQA

SEQ ID NO: 5833 - DNA, 1056 bp, Bacteroides fragilis
atgcaggataatatttctaactttaaaattctaagtatcgatggtggtgggatcagaggagtcattcccgcaaaaattttatgtgaccttgaagaggaagcgattaaaaaagatggtccggcagcccgtctctgcgactattttgatttggtttgtggtaccagtactggaggaattattgctattgggatcgcacttggtatgacagctaaagaaattctaaatctttatatgaaaaacgctacaaagatatttcccaaaaagaatatcataacttcctttaccaaaaacactccattctacgaaaagaaaccacttgaggaactattacaagagtgctatggcggctgtacacgtaatcgggatacccgtatccagcattgcaggacccggttgtgcataccgacttatgatttggacaagggagaagtacatgtgtttaaaacagaccatcttccacaataccatcgcgattgtcacgtgccggttgtggatgtcgctttagcaacggcagcagctcctgtttatttttctccccacacttttcaatacgaagatattggaacgactaacacaaatactttcactaacaatatagatggaggcgtattggctaacaacccggcacttatcggtctggcagaggctcagtactgtatcggtcatccgttggaaaacatcgaaatgttatcacttggtaccggcactgttaaccttaaagaaaacagaacgggcaagaagatgggtgtccgttattggattcaccccaagagtgagcagggcctgcgaatatatgaagtgatgtcatccgcacagtctctttttatagacaatatgatgaagatgattttcaaaggggctggacatggcggaaagcaacgattcaaatatgttcgggcgcaaaaagcattggatacaaatcttccccttgatacgacaaataaacattcactcgaccgtttgttgaacataggacaagaactatacaaggagcatggagaattgatgaaaccttttttagacaacaaaattattccatatgaacatcaagcataa

SEQ ID NO: 5834 - DNA, 1056 bp, Artificial Sequence
  Description of Artificial Sequence: Synthetic polynucleotide
atgcaagataacatctcgaattttaagatcctgagtattgacggcgggggcattcgcggtgtcatcccagcaaagatcttgtgtgacttagaagaggaagctatcaagaaggacggccctgccgctcgcctgtgtgattactttgatcttgtgtgcggtacgtcgacagggggaatcattgcaatcggaattgccctgggtatgacagccaaagagattctgaatttgtatatgaagaacgctacgaaaatctttcctaaaaagaatatcatcacgtcctttactaaaaacacaccattctatgaaaaaaaacccttagaggaattattgcaagaatgttatggcggttgtacacgtaaccgtgacacacgtatccaacactgccgtactcgtttgtgtattcctacttacgatcttgataaaggtgaagtgcatgtgttcaagacagatcacttaccgcaataccaccgcgattgccatgtacccgtcgtcgatgtagcattagcgactgccgcggctcccgtctatttttccccacacacattccagtacgaggatatcggcacgactaacactaacacttttactaataatattgatggaggcgtcttagcaaataacccggctttaatcggacttgccgaagctcaatattgtatcggtcatccgttagaaaatatcgaaatgctgtctttagggaccggcactgttaatcttaaagagaaccgcaccggcaagaagatgggcgttcgttactggattcacccgaaatcggagcaagggctgcgcatctacgaagtcatgtcatctgcacaaagcttgtttattgataacatgatgaagatgatttttaaaggcgccgggcatggcggtaaacaacgctttaagtacgttcgcgctcaaaaagccctggacacaaatttaccccttgacaccaccaacaagcactctcttgatcgtcttcttaacattggtcaagaactgtataaggaacacggagaacttatgaagccgttcttggacaataagattattccttacgagcatcaggcttaa

SEQ ID NO: 5835 - protein, 192 aa, Escherichia albertii
MWELLPSKIKYGISTIISIIVFLFFLEFLGQPVLKSVSYTITTITILAFIFGKYLWKYFYIDYLKHKFCPDFNGRWIGKIESNYSGGTKVEFPLEIKADFFSIKMKGNTTIGRTYSNYCKVVRAEDDSFELVYMFKVFNDTPSITDTSFYEGAARLRVIDIKTMNMKGVFWTNRCWENGKNTAGIIELSKEV

SEQ ID NO: 5836 - DNA, 579 bp, Escherichia albertii
atgtgggagcttttaccatcgaagataaaatatgggatatctactataatatctattattgtttttttgttttttttggagtttctcgggcaaccagttttgaagtcggtttcttatactattactactattacgattttggcttttatatttggtaagtatttatggaagtatttttatatagactatttaaaacataaattctgccctgattttaatgggcgatggataggtaaaatagagtcaaattacagtggtggaactaaggttgagtttccactggagattaaagctgattttttttcaattaaaatgaaaggaaataccacaatagggagaacttactcaaattactgtaaggttgtaagggctgaagatgatagttttgaacttgtatacatgtttaaagttttcaatgatacaccttcaataactgatactagcttttacgaaggtgcagccagattacgagtgattgatattaagacaatgaacatgaaaggggtgttttggactaatcgatgttgggaaaatggcaagaatacagcaggtataattgaactttcaaaagaagtttaa

SEQ ID NO: 5837 - DNA, 579 bp, Artificial Sequence
  Description of Artificial Sequence: Synthetic polynucleotide
atgtgggagttgctgccaagtaagatcaaatatggaatcagtacaattatctcaatcattgttttcttgttttttttggagttccttggacagcctgtcttaaagagcgtatcatacactattactactatcaccattttggctttcatcttcggaaaatatttatggaagtacttttacattgactacctgaaacataagttctgtcccgattttaatggtcgttggattggaaaaattgagtctaactatagtggtggcacgaaggtcgaatttccgttagaaatcaaagccgacttctttagcattaagatgaagggcaatactactattggccgcacgtactcgaattattgtaaagtagtccgtgcggaggacgattcgttcgaattggtatatatgtttaaggtatttaacgacaccccttctattacggatacatctttttatgagggagctgcacgcttacgtgtaattgacattaagaccatgaacatgaaaggcgtgttttggactaaccgttgttgggagaacggaaagaatactgctggaattattgaattatcgaaggaagtataa

SEQ ID NO: 5838 - protein, 256 aa, Clostridioides difficile
LSRYSPQTKYFEIAVKFKKVNTFLFWVFFILSIIFTFQNNNNLITCFSIISLIILNMLDIFICNYQEKGESKRRNDFIDNSFDCKYSTHNSIEYYDNDEIHYGLYKALVNVYQNAFFSKEILSYTRKFIIIKNVIPCMIIVIFSFIGFSNSNFALPILQLFFSKYFILDLINTSGYLKNVESVFDSITDMFETGLVAKKDNKVESKIIKVLINYETNISSSKIFLNSKVYKKMNPELTGEWDKIKKRYNIKEVSNI

SEQ ID NO: 5839 - DNA, 771 bp, Clostridioides difficile
ttgagtaggtattctcctcaaacaaaatattttgaaatagcagttaagtttaaaaaagttaacacatttttattttgggtattttttattttatcaataatattcacctttcaaaataataataatttaataacttgttttagtattatctctcttataatactaaacatgcttgatatctttatttgtaactatcaagaaaaaggagaatctaagagaaggaatgattttattgacaactcatttgattgtaaatattctacacataactcaatagaatattatgataatgatgaaatacattatggattatataaagctcttgtcaatgtatatcaaaatgcttttttctctaaagaaattttatcttatacaagaaaatttataataataaaaaatgtaataccatgtatgataatagttatattttcatttataggattctcaaatagtaattttgctttgcctatattgcaattatttttctcaaaatattttatattagacttaataaatacttctggatatttaaaaaatgtagaatcggtatttgatagcataacagatatgtttgagactggtctggttgcaaaaaaagataacaaggtagaatctaaaataataaaagttttaataaactatgaaactaatatctctagttcaaagatatttttaaattctaaagtatataaaaaaatgaaccctgaattaacaggagaatgggataaaataaaaaaaagatataatataaaagaggtgtcaaatatttga

SEQ ID NO: 5840 - DNA, 771 bp, Artificial Sequence
  Description of Artificial Sequence: Synthetic polynucleotide
atgtcgcgctacagcccacaaacaaaatactttgaaattgccgtcaaattcaaaaaggtgaacacgtttctgttctgggtgtttttcattctttccattatttttacgttccagaataacaataaccttatcacttgcttctccatcattagtctgattatcttgaacatgctggatatttttatctgtaactatcaggaaaagggcgaatcaaagcgtcgtaacgatttcattgataacagctttgattgtaagtacagtacccataattcgatcgaatactacgacaacgacgaaattcattacgggctttacaaggcattagtcaacgtataccaaaatgcgtttttcagcaaggagatcctttcatacacacgtaagttcattattatcaagaatgtgattccttgtatgatcatcgtaattttcagcttcattggatttagtaattcgaactttgctttacctattttacaactttttttctcgaaatacttcatccttgatcttatcaacacctccgggtacctgaaaaatgttgaatcagttttcgattcaatcaccgacatgttcgaaacgggcttggtggctaagaaagacaataaggtagagtccaaaattattaaagtactgattaattacgagactaatatctcctcgtcgaagattttccttaactccaaagtgtacaagaagatgaatcccgaattaacgggagaatgggataagatcaagaagcgttacaacatcaaagaagtaagcaacatctga

SEQ ID NO: 5841 - protein, 255 aa, Anoxybacillus thermarum
MTTGRIDTIDAYFQKVSRVNKWNSFLFWFSVFCSIAVFFTNNKPTVNYIMNIIFIITTVLYFIINNWLTLFLLREAQNKRRIHLLSDSLGVNLDDEQTNLYYNNSQSPSIIRLGVNVFENSLFTWRITEEMAKNERLKVSLYVLIWLLVMLIREVNLNFIAIIAQTLFTSGLIVNYVKLEILRNSCAQLFNEFRQIFLINGLNTNHQIVATILSLVFRYETVVASMGVHLSSKIFHRINPAVTDEWESVKRNLHL

SEQ ID NO: 5842 - DNA, 768 bp, Anoxybacillus thermarum
atgacgacaggacgtattgatacaatagatgcttactttcaaaaagtttctcgtgttaacaagtggaatagcttcttgttttggttttctgttttttgttctattgctgtattttttactaataataaacctacggttaattatataatgaatattatatttattattactactgtcttatactttattatcaataactggctaaccctttttttattaagagaggcacagaataaaagaaggatacatctgttgtctgattcactgggggtaaatctggatgatgaacaaacaaatttatattataacaattcacaaagtccttcgattatacgtctaggtgttaatgtatttgaaaactccttatttacatggagaataactgaagagatggcaaaaaatgaaaggctaaaagtatcactgtatgtattgatttggttacttgtgatgctcattcgggaggtaaatttgaactttatcgcaataatagcccaaacattatttacttctggcttaattgttaattacgtaaagttggaaattttaagaaactcatgtgcccaattattcaatgagtttagacaaatctttttaataaatggtttaaacactaatcatcagattgttgctaccatactaagtcttgtctttcgatatgaaacagttgtcgccagtatgggggttcatctatccagtaaaatttttcacaggataaatccagcggttacagatgaatgggaatcggtaaaacgaaacttgcatttataa

SEQ ID NO: 5843 - DNA, 768 bp, Artificial Sequence
  Description of Artificial Sequence: Synthetic polynucleotide
atgaccactgggcgcatcgacaccatcgatgcctactttcaaaaggtgtctcgtgtgaacaaatggaattcgtttttattttggttctcggtgttttgcagcattgccgtcttctttactaacaataagccgaccgtgaattatatcatgaacatcattttcattattactacggtcctgtactttattattaacaactggttaaccttattcctgcttcgcgaggcacaaaacaaacgccgcatccatctgttgagcgactcgttgggggtaaacctggacgatgaacagacgaatctgtactataacaattctcagagcccaagcatcatccgcttaggagtcaatgtctttgagaactcgttattcacctggcgcattacagaagagatggccaaaaatgagcgtttgaaggtttcactttatgtgcttatttggcttttggtgatgcttattcgtgaggtaaaccttaactttattgccattattgcacagaccctttttacatctggcttgatcgttaactacgtgaagttggagatcttacgtaattcttgcgctcaactgtttaacgagttccgccagatcttcttgatcaacgggttaaatacgaaccatcagattgtcgctaccattttatcacttgtatttcgctacgaaacggtggttgcatctatgggggtacatttaagcagtaaaattttccatcgtattaatccagcggttaccgatgaatgggaatcggttaaacgcaacttgcacctgtga

SEQ ID NO: 5844 - protein, 499 aa, Enterobacter cloacae
MATSVLANWHGHDYQARYFWIEASRLKNPQQDFVVEVSYEADGPKAFDDVITRYNPPRRSTGPDRIQADYYQIKFHVTQAASFGFEDLIDPAFIGAETFSILERLKQAKGTEPANSAFHLVTTDRIIDEDPLGEIISNVDGSIRLDKLFDGTTDRSRKGKVRKLWRQHLKLSTDQELEQVLSGFHIQQSQPTLEAMREKVNTCFQIIGLITCETSSDFRFDGAARALRSQERYRFTREQFTALCEEENWIRSEAPESFRNVALRSFSDGPLDIMDALPEHTLSLLSLFEGRFPSPGIEWNDVIKPQVETFLTGIRQTERKVRLYLNTHSSIAMLAGKCLGHKSGVEIELVQKGRMGDSIWSENESQDEPDAVIETETVGTGSDVAVVLSITRNALPKARAYILENQPDIGRIIHVTPANGHGQRSVKNGSHAVAIAEQVSDVVMDADLPVEASLHIFSAAPNAVNFYLGQHTDFLGTCVFYEFDFQRQRDGSYLPSFKV

SEQ ID NO: 5845 - DNA, 1500 bp, Enterobacter cloacae
atggcgacttctgtattggctaattggcacggccatgattaccaggctcggtatttctggattgaggcatcccggcttaaaaatccccaacaagatttcgtcgtagaagtttcctatgaagccgatggccctaaagcctttgatgacgtgattacgcgttataatcccccccgccgcagcaccgggcccgaccggattcaggccgattactatcaaatcaagtttcacgttacacaagccgctagcttcggattcgaggacctgattgaccctgcattcatcggtgctgaaaccttctcgatccttgaaaggctaaaacaggcaaaaggaactgagcctgccaactctgcttttcatcttgtcacgacagatcgaattatcgatgaggacccgcttggtgaaataatcagcaatgtggatggctcaatacgactcgataagttgtttgatggcacgaccgacaggagccgtaagggaaaggttcgcaagctttggcgccaacatcttaagctttccacagaccaggagctggagcaggtgctttctggttttcacattcagcagtcacagcccacgcttgaagcgatgcgtgaaaaagttaatacctgcttccagatcattggcttgataacctgcgaaacaagttcggacttccgtttcgatggcgctgcgcgtgccttacgcagtcaggaacgttatcgctttacccgagagcaattcacagccctttgcgaggaagagaactggatcagatcggaagcacctgaaagcttcagaaatgttgcgctacgctctttcagcgatgggccactggacatcatggatgcgcttccggaacacacactctccctgctttctctcttcgaaggtcgatttccctccccgggcattgagtggaatgatgttattaagccccaagtagaaaccttcctcacaggtataaggcagacggagcgtaaagttcggctgtatctaaatacccacagctccattgcaatgcttgccggcaaatgtcttggtcacaagtcgggcgtagaaatcgaactggtccagaaagggagaatgggcgactccatctggtctgagaacgaatcgcaggatgaacctgatgcggttatcgaaaccgagactgtcggaaccggaagcgatgtcgctgtagtgctcagcatcacgagaaatgcgctgccaaaagcacgcgcatacatactcgaaaatcagcctgacataggacgtatcattcacgttacccccgcaaacgggcacgggcaacgatctgtgaaaaacggttcacatgccgtagcgattgccgaacaggtatccgatgtagtcatggatgcagatttaccggttgaggcaagcctgcatattttcagcgctgcgccaaatgccgttaatttttatcttggccagcacacggattttctggggacatgcgtcttttacgagtttgactttcaacgccaacgagatggctcctaccttccttcatttaaggtttaa

SEQ ID NO: 5846 - DNA, 1500 bp, Artificial Sequence
  Description of Artificial Sequence: Synthetic polynucleotide
atggcgacctcagtgctggcaaactggcacggacatgattatcaagcccgctacttctggatcgaggcctcgcgccttaaaaacccacagcaggattttgtcgtggaagtaagctatgaggcagacggtccgaaagcctttgatgacgttatcactcgctataaccccccccgtcgctcgacaggaccagaccgtattcaggccgattattaccagattaagttccacgtgacccaggcggctagctttggttttgaggatcttattgatccagcgtttattggcgctgaaacattctccattttggagcgcttgaagcaggccaagggtacagagcccgcgaactccgcgtttcatcttgtgacgacagatcgtatcattgatgaggacccactgggtgaaatcattagcaatgtcgatggttctattcgcctggacaaactgttcgatggaacaactgaccgttctcgtaagggaaaagtccgcaagctgtggcgtcagcacctgaaactttcaactgaccaagaactggagcaagtgttatccggtttccacatccagcaatcacagccgaccctggaagctatgcgcgaaaaagtcaacacttgttttcagattattgggcttatcacttgcgaaacttccagtgactttcgcttcgatggagcggctcgcgcattacgctcccaggaacgttaccgcttcacacgcgaacagtttactgcactttgtgaagaagaaaattggattcgtagcgaggcccctgagtcatttcgcaatgtggcgcttcgtagtttctcagacggaccgttggatatcatggatgcattgcctgagcatactcttagtcttctttccctgtttgaaggccgctttccgtctcctggaatcgaatggaatgacgttatcaagccacaggtcgaaacgttcctgacaggtatccgccagactgagcgtaaggtacgcttgtacttgaatacccactcatcaatcgccatgcttgccggcaagtgtctggggcataaatctggtgtggagatcgaattggtgcagaagggacgtatgggtgacagcatctggtccgagaatgagagccaagacgagccagacgccgtcatcgagacggagacggttggaaccggctccgatgtggccgtagtcttgagcatcactcgtaacgcgcttcccaaagcgcgcgcctacattttggagaatcaaccggacattggccgtattatccacgtaacacctgccaacggtcacggccagcgttcggttaagaatggcagtcatgccgtggcgattgctgaacaagtgtctgacgtagttatggacgccgatctgccggtagaagctagtcttcatatcttctctgccgccccgaatgctgtaaatttctatttaggacagcacacagatttcttgggcacttgcgtattctatgaatttgattttcaacgtcagcgtgatggtagttatcttcccagctttaaggtctaa

SEQ ID NO: 5847 - protein, 378 aa, Bradyrhizobium japonicum
VASVSKSSIPQKVQSALWARAAGRCQYRGCNTDLVGDLVAGRQDGIFGFIAHIVADVEGGPRGDPIRSTQLARSLENLMLMCARHHKLIDLDAVADHPESVLLTMKAEHEGRIAIVAGIDEDRASHVIRFGASICDNEALVSTQAIFSAMPPDRHPASGQRLDLEMVGCAFRDNEPAYWTVQRENLRRQFEAKVRGRVERQEIRHLSVFALAPQPLLIELGRLLCDIVPAVVHQRHREPASWRWASDGPPITFQVTEPDIGLSGSVALKLGVSATVTDARLQAVLGDEAAIWSLCADQPHNDVLRRADDQAAFRRELRRLYDRIKARHGEGTLLHVFPALPASLAVEVGRVWMPKSDLSLRLYDNNRSHGFIRTFDIP

SEQ ID NO: 5848 - DNA, 1137 bp, Bradyrhizobium japonicum
gtggcgtcggtgtctaagagcagcattccgcaaaaggtccaatcggcgctgtgggcgcgggctgctggccgctgccaatatcgtggatgcaatactgatttggtcggcgacctggtggccgggcggcaagacgggatcttcggcttcatcgcacacatcgtggctgacgtcgaaggcggcccgcgcggcgatccgatccggtcgactcagctcgcgcgtagtctggaaaatctaatgttgatgtgcgcccgacatcacaagctgatcgatcttgacgccgtcgccgatcatccggaatctgttctgctaactatgaaagccgagcacgagggccggatcgcgatcgttgccggcatcgacgaagaccgggcatctcacgtcatcaggtttggggcgagcatttgtgacaacgaggcgcttgtatcgacgcaggcgatcttttcggcgatgccgcccgaccgccacccagccagcggccagaggttggatcttgaaatggtaggctgtgcgtttcgagacaacgagcctgcctattggacggtccagcgcgagaacctgagacgccagttcgaagcgaaggtgcgaggccgcgtagagcgacaggagattaggcatctaagcgtattcgcactcgcaccgcagccgctgctgatcgagcttggccggctgctctgcgatatcgttccggccgtcgttcatcaaaggcatcgcgaacccgcgagttggcgatgggcgtccgatggccccccgatcacattccaggtcaccgaaccggatatcgggctgtcaggctcggtcgcgctaaagctcggtgtcagcgctaccgtgaccgacgcgcgactccaggcggttctcggcgacgaagccgcgatctggtcgctctgcgcggatcaacctcacaacgacgtcttgcggcgagctgacgatcaggccgcatttcggcgcgaactccgacggctctacgaccgcatcaaggctcggcatggcgagggaacgctgctgcatgtttttcccgcgcttcccgcctccctggcggtcgaggtcggccgcgtctggatgcccaaatcggatctttccctccggctctacgacaacaatcgatcgcacgggttcatacggaccttcgatattccctaa

SEQ ID NO: 5849 - DNA, 1137 bp, Artificial Sequence
  Description of Artificial Sequence: Synthetic polynucleotide
atggccagcgtctcaaagtcgagcatcccacaaaaggtccagagtgccttatgggctcgcgcggccgggcgttgtcagtaccgcggatgcaacactgacttggttggtgatttggtagccggtcgtcaggacggaatttttggttttatcgcccatattgtagcagatgttgaaggaggcccccgcggtgaccctatccgtagcacacagctggctcgctcacttgaaaacctgatgcttatgtgcgctcgtcaccataaactgattgatcttgacgctgtcgccgatcatccagaatctgttcttttaaccatgaaggcagagcacgaagggcgcattgctattgtcgccggaattgatgaggaccgtgcaagccatgtaatccgtttcggggcctccatttgtgataacgaggctcttgtctctacccaagccatcttcagcgccatgccacccgaccgtcatcccgcgagtgggcaacgtttggacctggaaatggttggctgcgctttccgtgacaacgagcccgcctattggacggttcaacgtgaaaacctgcgtcgccaattcgaagccaaggtgcgcggccgtgtagagcgtcaggagatccgtcatcttagcgtctttgccttggctccgcaacctcttctgatcgaactggggcgcctgttgtgtgatattgtccccgcagtagttcatcaacgccaccgcgaacccgcgtcgtggcgttgggcgtcggatggcccccctattacgttccaagtaaccgaaccggacattggattaagtggaagtgtggcattaaaattaggagtgagtgctacagtcacggacgcccgtcttcaagctgtcttgggtgacgaggctgctatttggtcgctttgtgctgaccagccccacaatgacgtcttacgtcgtgctgacgaccaggctgctttccgccgcgagttgcgccgtctgtatgaccgtattaaggcacgtcacggtgaagggacattgttgcacgtgtttcctgcattgccagctagcttagcggttgaagtggggcgtgtgtggatgccaaagagcgatttaagtctgcgcctgtatgacaacaatcgctcgcatgggttcattcgcaccttcgacatcccttaa

SEQ ID NO: 5850 - protein, 338 aa, Rhodopseudomonas palustris
MTQVAVPSDKPPIRRILSIDGGGIMGTQPASFLTSLEEDLDRPIGEYFDLIAGTSTGGILAIGLAMGLPARDLLDLYVRRGPHIFGQSGGALASFAGDAWRRLKHIVTPKHDADLLRSELSTVLGSRRIGDARTRLVIPAWDADHRGVYIFKTAHHPRLKTDYKRLAVDAAMATAAAPTYYKRHRTAEDVGLLDGGVWANNPIALAVVEAVTLLDWPASSLRVLSLGCVNEVYMIGEAPGWGGLAKDVTRLFMDGQSHGALGMAKLLTGHQYEREAIFRCCPDVPKDFFNLDDTRKIAQLKGMGASSARKERPRIEPVFLTETAESFKPIYTVKGIEP

SEQ ID NO: 5851 - DNA, 1017 bp, Rhodopseudomonas palustris
atgacgcaggttgcagttccttcagataaaccgccgattcgtcgaattctctcgattgacggcggcggcatcatgggaacgcagccggcgtcctttcttacgtctctggaagaggatctcgaccggcccatcggagagtatttcgatctgatcgcaggaacgtccacgggcggcattctggcgatcggattggcgatgggtcttcccgcgcgtgatctccttgacctctatgtccgtcgcggcccacacatttttggacagtcgggcggcgctctggcgagcttcgccggcgacgcgtggcgtcgcctcaagcacatcgtcaccccgaagcatgacgctgatctgctgcggagcgaactctctacagttctcggcagcaggcgcattggggatgcgagaacgcgactggtgattcccgcatgggatgccgaccatcgcggtgtctatattttcaagacagcgcatcatccccgcctcaagaccgattacaagcgcctcgccgtcgatgccgcgatggcgacggccgccgcgcccacctactacaagcgccaccggaccgccgaggatgtcggtctgctcgacggcggcgtatgggccaacaacccgatcgcgttggcggtggtcgaggccgtcactttgctcgactggccggccagcagtctgcgagtgctgagcctgggctgcgtcaacgaggtctacatgatcggcgaggcgcctggttggggcggtctcgcaaaggatgtgacccgcctgttcatggacggccagtcgcatggcgcgcttggtatggcgaagttgcttaccggccatcaatacgaacgtgaggcgattttccggtgctgcccggatgtgccgaaggatttcttcaatctcgatgacacgcgcaagatcgcgcaactcaaaggcatgggcgcctcatcagctcgtaaggagcgtcctcgcattgaacccgtttttctgacggaaactgccgaatcgttcaaacctatctacaccgtgaaaggaattgagccatga

SEQ ID NO: 5852 - DNA, 1017 bp, Artificial Sequence
  Description of Artificial Sequence: Synthetic polynucleotide
atgacacaagtcgctgtccctagtgataagcccccgatccgtcgcattctgagtattgacggaggtggtattatgggcacgcagcctgcctcattcttgacatcacttgaagaagacctggatcgcccgattggggaatactttgacctgattgcagggacctctacaggtgggattcttgccattggtttggccatgggtcttccagcccgtgatttgctggacttatatgttcgccgcggtcctcatatttttggacaatcaggcggagcattagctagcttcgctggggatgcatggcgtcgtttgaaacatattgtaacaccaaaacacgacgccgacttactgcgtagcgagttgtcaacagtacttgggagtcgccgtattggagatgctcgtactcgtttagtcattcccgcttgggacgctgaccaccgtggggtgtacatctttaagacagcgcatcacccgcgtctgaagaccgattacaagcgtttggcggtagatgcggccatggccactgctgccgctccgacatattacaaacgccaccgtactgcggaggatgtaggcctgctggatgggggagtttgggctaacaacccgatcgccttagccgtcgttgaagctgtaacattgcttgattggcctgcttcatcgttgcgtgtcctgtccctgggatgcgtcaacgaagtgtatatgatcggtgaagcaccgggctggggaggtttagcgaaagacgtgacccgcttatttatggacggtcaaagtcacggtgccttgggtatggctaagttgcttacaggccaccaatacgagcgcgaagctatttttcgctgttgtccagatgtcccgaaggacttctttaatcttgatgatacacgcaagattgcacagttaaaaggaatgggtgcgagttctgcgcgcaaagagcgcccccgtatcgaacctgtgttcctgaccgaaactgcggagagtttcaagcccatctacactgtaaagggtatcgagccataa

SEQ ID NO: 5853 - protein, 320 aa, Escherichia coli
MTYSVSPSSLLTEYGNDNICRVLALDGGGAKGFYTLGVLKEIEAMLGCPLYKRFDLVFGTSTGAIIAALIALGYEVDQIHALYTEHVPRVMSSRSAAARTMALQDLAKEVFQDKTFEDVLMGIGIVATRWMTERPMIFKGNVVQAHGRKGTFSPGFGVSIADAVQASCSAYPFFERKVIVTAAGDKVELIDGGYCANNPTLFAIADATVALKKDHKDIRVINVGVGIYPEPKPGLLMRIAKKWLAVQLLQKTLEINTQSMDQLRDILFKDIPTIRISDTFERPEMATDLLEYNLDKLNTLRQRGRESFGAREAQLREFLI

SEQ ID NO: 5854 - DNA, 963 bp, Escherichia coli
atgacttactctgtttcgccgtcatcactactcaccgagtacggcaacgacaacatatgccgtgttctcgcacttgatggtggcggtgcaaagggcttttatacgctgggtgtcctcaaggaaattgaggctatgcttgggtgcccattatataagaggtttgatcttgtatttggtactagcaccggtgcgattattgccgcgctcatcgctctaggatacgaagtagatcaaatacacgcactgtacaccgaacatgtaccacgagttatgtccagccggtcggctgcggcaagaacaatggcgctccaggatttggctaaggaagtttttcaagacaagacattcgaagatgttctgatgggtattggcatcgtcgcaactcgatggatgaccgaaagaccaatgatcttcaaaggtaatgttgtgcaggcccatggtcgcaagggaaccttcagtcctggattcggggtcagcatcgctgatgcagtgcaagcgtcttgctcggcttatccgttcttcgaaaggaaagtgattgttaccgcagcaggagataaggttgagttgatcgatggaggttactgcgcaaacaaccccaccttgtttgcaatcgccgacgccactgtcgctctgaaaaaagatcacaaggatatccgggttataaatgtcggtgttggtatctatccagaacctaaaccaggtctccttatgcggattgctaagaaatggctcgcagtccagctgcttcaaaaaactttagagatcaatacacaatcgatggatcaactacgcgacattctattcaaagatattccgacgattcggatcagcgacacattcgaacggcctgagatggcgacagatttacttgagtacaatttagataaactgaatacccttcgacagcgtggtagggagtcttttggagctcgtgaggcacaattaagagagtttctgatatga

SEQ ID NO: 5855 - protein, 207 aa, Legionella pneumophila
MEKKHIQALVWILAPIWAILLFIDGVIPVTFAFFKPASLVTALAIFFVGAFDKWIWKWKMLHPWFVSIPNLSGTWKAKLKSSWIDKKTGERLTDIEAYFIIQQTLSNIKVTLLTKESSSDLIGGELIKDKNNGKFYITGVYLNEPKLLQVKDSPMHYGALFCKIMVNKGAIGMDGCYWTSRETKGEITFLKHSKHIYSSFDECNKNL

SEQ ID NO: 5856 - DNA, 624 bp, Legionella pneumophila
atggaaaaaaaacatatacaagcgctagtttggatacttgcaccaatttgggcaatcttattatttattgatggtgtaattcctgtcacctttgcgttttttaaaccggcgtcattagttactgcgttagcgattttttttgttggtgcttttgataagtggatatggaaatggaaaatgctacacccttggtttgtttccataccaaacctttcgggtacttggaaagcaaagctcaaatcaagctggattgacaaaaaaacaggggagagactaactgatattgaggcttacttcattattcaacaaacgcttagcaatattaaagtcaccctattaacaaaagaatctagctcagatcttattggcggtgaattaataaaagataaaaataacggtaaattttacatcactggtgtttatctaaatgagccaaaacttcttcaagttaaggatagccctatgcattatggcgctctgttttgtaaaattatggttaataaaggcgcgattggaatggatgggtgttattggactagccgagaaacaaaaggtgaaataacatttttaaagcattctaagcatatttattcgagttttgatgagtgtaataaaaacttataa

SEQ ID NO: 5857 - DNA, 624 bp, Artificial Sequence
  Description of Artificial Sequence: Synthetic polynucleotide
atggaaaagaagcacatccaggctcttgtctggattctggctcccatttgggccattcttctgttcatcgacggtgtgattcctgtcacgttcgcgtttttcaaacctgcttccttggtcacagcgcttgccattttttttgtcggagcattcgacaaatggatttggaaatggaaaatgttacacccttggttcgtaagcattcccaacttgtcaggaacatggaaggcgaaattaaagagcagttggatcgacaaaaaaacaggtgagcgtcttactgacattgaggcatatttcattattcaacaaacgctgtcaaacattaaagtgaccttattaaccaaggagtcgtcatccgaccttattgggggggaacttatcaaggacaaaaacaatggtaaattctatatcacgggggtttaccttaatgaaccaaagttattgcaggttaaggattcaccgatgcattacggggctctgttctgtaagattatggtgaacaaaggagccattgggatggacggatgttactggacctctcgcgaaactaaaggtgaaattaccttcttgaagcacagtaagcacatttattcatcgttcgatgaatgcaataaaaatctttga

SEQ ID NO: 5858 - protein, 198 aa, Legionella pneumophila
MGHLNVRMVISILVATTILVWGIILLISGIKLTGSWDAITKLPQVVTIEVFLWFGFRRWFWRAKLFQGWLVPFPNLQGKWEGELKSTWINPETGEGVQPIRVEMSIVQDFSHICCSIRTGESTSKSYIANFNLDSESCTKYLIYSYANKPRAEVRNRSEMHNGTAYLEVLNNGTKLKGDYWTDRKTTGELELRKMENE

SEQ ID NO: 5859 - DNA, 597 bp, Legionella pneumophila
atgggtcatttaaatgttcgaatggttatttcgatacttgttgctactactatcttggtatggggaattattttgctcatatctggtatcaaattaacagggagttgggatgcaattacaaaactcccacaagtagttacgatcgaggtgtttttgtggtttgggtttaggcgttggttttggcgagcaaagctattccaaggatggcttgtaccatttccaaatttacaagggaaatgggaaggcgaattaaaatccacttggataaaccctgaaacaggagaaggcgtacaacctattcgtgtcgaaatgagtattgtacaagatttctcccatatttgttgcagtatccgcacaggggaatcaactagcaaaagctatattgctaattttaacttagatagcgagagctgtactaaatatttaatctatagttatgcaaataagccgagagctgaagtaagaaatagaagtgagatgcacaatggaactgcatatcttgaagtgttgaacaatggaacaaagctgaaaggtgattattggacagatcgcaaaacaacaggtgagcttgagctaagaaagatggaaaatgaataa

SEQ ID NO: 5860 - DNA, 597 bp, Artificial Sequence
  Description of Artificial Sequence: Synthetic polynucleotide
atgggacatctgaatgtccgcatggtaatcagcatcttagtagcgacaactattctggtatgggggatcatcttacttatctctgggattaaattaaccgggtcatgggacgcaattaccaaattgccacaagtagttactattgaggtatttttgtggtttggatttcgccgctggttctggcgtgcaaaattgttccaaggttggttagtgccctttcccaatcttcagggcaagtgggaaggagagctgaaatcgacctggattaacccagaaacaggtgaaggggtacagccgattcgtgttgaaatgtctattgtccaggatttctcccacatttgttgttcgatccgtacgggcgaaagtaccagcaagtcttacatcgccaatttcaacctggacagcgagtcatgtacgaagtaccttatctactcatacgcgaacaagccgcgcgcggaggtacgtaaccgcagcgaaatgcacaacgggactgcttaccttgaggtcctgaataatggtacaaagttgaagggtgactattggacagatcgcaagactactggtgaacttgagttacgcaaaatggagaatgaatga

SEQ ID NO: 5861 - protein, 208 aa, Klebsiella pneumoniae
MKSHEYIVICGFNRSKVGRYIAIVASVISFVLILLALTLIEWLKNFHINSHIPASVFSLISAGGIYMGLYTWFDKNLWHNTYLGKFLCVPNLAGRWNVEGHTRSEGGKPWEGELRIVQSWDKVRIHLKTQSSHSDSVTASIIHDEGIGYQLLYNYRNQPKTGEEHLTSHVGFAEFRFDDGLKSAEGHYFNGQGRATYGTMTITRIDNV

SEQ ID NO: 5862 - DNA, 627 bp, Klebsiella pneumoniae
atgaaaagtcacgagtacattgtgatttgcggttttaaccgcagtaaagtcggccgatatattgccattgttgcctcagttatatcgttcgttctgattttactagcactcacactaatcgaatggctgaaaaactttcacattaacagccacatacctgcctcagttttttcacttattagcgccggtgggatctacatggggttgtatacatggtttgataaaaatctctggcataacacctacctcgggaaatttttatgtgtgccaaatcttgcaggccgctggaatgttgaaggccatacccgatctgaaggtggtaaaccctgggaaggtgagctgagaattgtccagtcatgggacaaagtcagaattcatctgaaaactcaatcatcgcattcggatagtgtgacagcctccatcattcatgacgagggaattggttaccagctgctttataactaccgcaaccaacccaagacaggtgaagaacacctgacttcacatgttggattcgcagagttcaggttcgacgacggactcaaatctgctgaaggccattattttaacggtcaaggccgggctacttacggaacaatgacaatcactaggatcgacaatgtctaa

SEQ ID NO: 5863 - DNA, 627 bp, Artificial Sequence
  Description of Artificial Sequence: Synthetic polynucleotide
atgaaaagccacgagtacattgtcatctgcggttttaaccgtagtaaagtaggtcgttatattgccattgtggcgtcggtcattagctttgtccttatcttgctggctctgacacttatcgaatggttaaagaactttcatattaactcgcacattcctgcgtctgtattcagccttattagcgcaggtggtatctatatgggactttacacatggttcgataagaatctgtggcacaatacctatctggggaaatttttgtgtgtacctaacctggctggtcgttggaatgtagaaggacatactcgctctgaagggggaaaaccatgggagggcgaactgcgcatcgtccaatcgtgggacaaggtccgtatccacctgaaaacgcagtctagccactcggactctgtaacggcatcaatcattcatgacgagggcatcgggtatcaacttttatacaattaccgcaatcaaccgaaaactggtgaggaacatttgacgtcccatgtcggctttgctgagttccgctttgacgatggactgaaaagcgcagaaggccattactttaacgggcaaggccgcgctacctacggaacgatgactatcactcgtatcgacaatgtatga

SEQ ID NO: 5864 - protein, 214 aa, Pseudomonas syringae
MIHDHEYSLLGGVNRALIGRYLTLLASAISGIAVFLLLSAEDLAKKYDLPVNLPPTALSLIGAGIVFALLYALFNKTVWKWRWAVKYLKVPDLSGEWQCTGTTLDTEGNPIRSWQADVYICQTWDKIRVRLKTHQSGSNSITAALVHDEADGYRLLYNYRNDPNPGEPELRGHVGSANLLFTKSLDCAQGDYFNGYGRPTYGRMELRRKNEHTN

SEQ ID NO: 5865 - DNA, 645 bp, Pseudomonas syringae
atgattcacgatcatgaatacagcctattgggcggagtaaatcgagctctgattggccggtacttgacactactggcaagcgcgatttccggcattgcggtttttttgctgctgtcagctgaagatttggctaaaaagtatgacctgcctgtaaatcttccaccgacagccctgtcactaattggcgcaggtatagtttttgccctgctgtacgctctattcaataagacagtttggaaatggcgctgggcagttaaatatctaaaagttcctgatctgtcgggagagtggcagtgcactggaacaacactggacaccgaaggaaatccgattcgctcttggcaagccgatgtatatatttgtcaaacttgggacaagattagagtgcgattgaagacacatcaatcaggctccaacagtatcactgcggcgttggttcacgatgaagctgacgggtatcgccttctttataactaccggaatgatcctaatcccggcgaacctgagcttcggggacatgttggcagcgcaaaccttttgtttactaaatcactagattgcgcacagggtgactattttaacggttacggtcggcccacctatgggcgaatggagctgaggagaaaaaatgaacacaccaattaa

SEQ ID NO: 5866 - DNA, 645 bp, Artificial Sequence
  Description of Artificial Sequence: Synthetic polynucleotide
atgatccatgaccatgaatactcattattaggtggggtcaatcgcgccctgatcggtcgttacttgaccttgcttgcctccgcgatctctgggatcgcggtattcctgctgctgtcagcggaagacctggccaagaagtatgatttaccagttaatctgccacccacagcattgagcctgattggagctggaatcgtattcgcactgctttatgcgctgtttaataaaacggtctggaaatggcgttgggctgttaagtacttaaaggtccctgatctgtcgggggagtggcaatgtaccggaacgacattggatacggagggaaatcccattcgctcttggcaagcggacgtatatatctgccagacatgggataagattcgtgtccgtctgaagacacaccagagcggctcgaattccattacagcagcgctggttcacgatgaggcagacggctatcgccttttatataactatcgtaacgacccgaatccaggagaaccggaattgcgcggacatgttggatcggctaatttactgtttacaaaatctctggattgtgctcaaggcgactactttaatggttatgggcgtcctacttatggacgtatggagctgcgtcgtaaaaatgaacacacaaactga

SEQ ID NO: 5867 - protein, 362 aa, Artificial Sequence
  Description of Artificial Sequence: Synthetic polypeptide
GASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

SEQ ID NO: 5868 - protein, 297 aa, Xanthomonas arboricola
MGIPESQLETWSHQGSITQSASTYSTIKNALESASAAYHGKNFKVFLQGSYGNDTNIYAESDVDVVIRLDDVYYSDLTQLSPEDKEAYDHAFVPATYSYDQYRQDVLKALTDRFGSDVKAGDKAIAVEANGNRRKADVIASMQFRRYWKFKGTYDSHYDEGICFFNEAGERIANYPKQHSENLTRKHQGSNKWLKPMVRVLKNLRSKLVADGTLKAGTAPSYYLEGLLYNVPNEKFGISYADCFVNAMNWIQTEADKDKLLCANEQYYLLWEGTHTSWEKADAEAFIGAAIKMWNEW

SEQ ID NO: 5869 - protein, 299 aa, Mycobacterium avium; identical to SEQ ID NO: 1244

SEQ ID NO: 5870 - protein, 292 aa, Elizabethkingia meningoseptica; identical to SEQ ID NO: 201

SEQ ID NO: 5871 - protein, 432 aa, Unknown; identical to SEQ ID NO: 6
  Description of Unknown: Enterobacteriaceae sequence

SEQ ID NO: 5872 - protein, 380 aa, Unknown; identical to SEQ ID NO: 8
  Description of Unknown: Proteobacteria sequence

SEQ ID NO: 5873 - protein, 347 aa, Unknown; identical to SEQ ID NO: 32
  Description of Unknown: Enterobacteriaceae sequence

SEQ ID NO: 5874 - protein, 346 aa, Unknown; identical to SEQ ID NO: 38
  Description of Unknown: Bacillaceae sequence

SEQ ID NO: 5875 - protein, 251 aa, Unknown; identical to SEQ ID NO: 53
  Description of Unknown: Proteobacteria sequence

SEQ ID NO: 5876 - protein, 315 aa, Unknown; identical to SEQ ID NO: 62
  Description of Unknown: Enterobacteriaceae sequence

SEQ ID NO: 5877 - protein, 300 aa, Unknown; identical to SEQ ID NO: 71
  Description of Unknown: Proteobacteria sequence

SEQ ID NO: 5878 - protein, 331 aa, Unknown; identical to SEQ ID NO: 81
  Description of Unknown: Enterobacteriaceae sequence

SEQ ID NO: 5879 - protein, 431 aa, Unknown; identical to SEQ ID NO: 87
  Description of Unknown: Campylobacter sequence

SEQ ID NO: 5880 - protein, 381 aa, Unknown; identical to SEQ ID NO: 112
  Description of Unknown: Enterobacteriaceae sequence

SEQ ID NO: 5881 - protein, 399 aa, Unknown; identical to SEQ ID NO: 145
  Description of Unknown: Bradyrhizobiaceae sequence

SEQ ID NO: 5882 - protein, 401 aa, Unknown; identical to SEQ ID NO: 154
  Description of Unknown: Enterobacteriaceae sequence

SEQ ID NO: 5883 - protein, 297 aa, Unknown; identical to SEQ ID NO: 166
  Description of Unknown: Enterobacteriaceae sequence

SEQ ID NO: 5884 - protein, 378 aa, Unknown; identical to SEQ ID NO: 183
  Description of Unknown: Enterobacteriaceae sequence
